United States Patent
Dauner et al.

(10) Patent No.: US 12,509,677 B2
(45) Date of Patent: Dec. 30, 2025

(54) PROBIOTIC STRAINS HAVING INCREASED STORAGE STABILITY

(71) Applicant: DUPONT NUTRITION BIOSCIENCES APS, Copenhagen K (DK)

(72) Inventors: Michael Dauner, Wilmington, DE (US); Gerda Saxer Quance, Wilmington, DE (US); Steven Keith Williams, Corinth, TX (US)

(73) Assignee: INTERNATIONAL N&H DENMARK APS, Kongens Lyngby (DK)

( * ) Notice: Subject to any disclaimer, the term of this patent is extended or adjusted under 35 U.S.C. 154(b) by 1102 days.

(21) Appl. No.: 17/606,292

(22) PCT Filed: Apr. 23, 2020

(86) PCT No.: PCT/EP2020/061385
§ 371 (c)(1),
(2) Date: Oct. 25, 2021

(87) PCT Pub. No.: WO2020/216863
PCT Pub. Date: Oct. 29, 2020

(65) Prior Publication Data
US 2022/0204966 A1 Jun. 30, 2022

Related U.S. Application Data

(60) Provisional application No. 62/838,985, filed on Apr. 26, 2019.

(51) Int. Cl.
*C12N 15/01* (2006.01)
*C12N 1/20* (2006.01)
*C12R 1/23* (2006.01)

(52) U.S. Cl.
CPC ............ *C12N 15/01* (2013.01); *C12N 1/205* (2021.05); *C12R 2001/23* (2021.05)

(58) Field of Classification Search
CPC ...... C12N 15/01; C12N 1/205; C12R 2001/01
See application file for complete search history.

(56) References Cited

U.S. PATENT DOCUMENTS 8,741,622 B2 6/2014 Berger et al.

OTHER PUBLICATIONS

Chen et al. "Adaptation of Lactococcus lactis to high growth temperature leads to a dramatic increase in acidification rate". Scientific Reports vol. 5, Article No. 14199 (2015). doi: 10.1038/srep14199 (Year: 2015).*

Dong et al. *Bifidobacterium thermacidophilum* sp. nov., isolated from an anaerobic digester. International Journal of Systematic and Evolutionary Microbiology (2000), 50, 119-125. (Year: 2000).*
Stress responses and genetic variation in bacteria. Mutation Research/Fundamental and Molecular Mechanisms of Mutagenesis, vol. 569, Issues 1-2, 2005, pp. 3-11. (Year: 2005).*
Simpson et al. *Bifidobacterium psychraerophilum* sp. nov. and *Aeriscardovia aeriphila* gen. nov., sp. nov., isolated from a porcine caecum. International Journal of Systematic and Evolutionary Microbiology (2004), 54, 401-40. (Year: 2004).*
*Bifidobacterium animalis* subsp. lactis Bi-07 supports lactose digestion in vitro and in randomized, placebo- and lactase-controlled clinical trials. Am J Clin Nutr. Sep. 23, 2022;116(6):1580-1594. (Year: 2022).*
Bhavsar et al. The other lives of ribosomal proteins. Hum Genomics. Jun. 2010;4(5):327-44. (Year: 2010).*
The Leibniz Institute. Bifidobacterium thermacidophilum DSM 15837. URL: www.dsmz.de/collection/catalogue/details/culture/DSM-15837. Accessed Jun. 11, 2025. (Year: 2000).*
Biavati, B. and Mattarelli, P. (2015). Bifidobacterium †,‡. In Bergey's Manual of Systematics of Archaea and Bacteria (eds M.E. Trujillo, S. Dedysh, P. DeVos, B. Hedlund, P. Kämpfer, F.A. Rainey and W.B. Whitman). (Year: 2015).*
Rasinkangas et al. (*Bifidobacterium animalis* subsp. lactis Bi-07 supports lactose digestion in vitro and in randomized, placebo- and lactase-controlled clinical trials. Am J Clin Nutr. Sep. 23, 2022;116(6):1580-1594. (Year: 2022).*
STAHL, et al., "Complete Genome Sequences of Probiotic Strains *Bifidobacterium animaiis* subsp. lactis 8420 and Bi-07", J. Bacteriology, pp. 4131-4132, vol. 194, No. 15. (2012).
Lalicic-Petronijevic, et al., "Viability of probiotic strains Lactobacillus addophilus NCFM® and Biftdobacterium lactis HN019 and their impact on sensory and rheological properties of milk and dark chocolates during storage for 180 days", J. Functional Foods, vol. 15, pp. 541-550 (2015).
Gueimonde, et al. "Enhancing probiotic stability in industrial processes", FFF Probiotics, vol. 23 (2012).
Chen, et al., "Adaptation of Lactococcus lactis to high growth temperature leads to a dramatic increase i acidification rate", Scientific Reports, pp. 1-15 (2015).
Dettman, et al., "Evolutionary insight from whole-genome sequencing of experimentally evolved microbes" Molecular Ecology, vol. 21, pp. 2058-2077 (2012).
Barrick, et al., "Genome dynamics during experimental evolution" Nature Reviews, vol. 14, pp. 827-839 (2013).

* cited by examiner

*Primary Examiner* — Brian Whiteman
*Assistant Examiner* — Amanda M Zahorik

(57) ABSTRACT

Evolved strains of *Bifidobacterium* and *Lactobacillus* are provided. The evolved strains have probiotic properties and have enhanced storage stability in both wet and dry conditions. The strains of the invention contain key genetic mutations and phenotypic alterations as compared with wild-type.

1 Claim, 20 Drawing Sheets
Specification includes a Sequence Listing.

PROBIOTIC STRAINS HAVING INCREASED STORAGE STABILITY

CROSS-REFERENCE TO RELATED PATENT APPLICATIONS

This patent claims priority under 35 USC § 371 as a national phase of Int'l Patent Appl. PCT/EP2020/061385 (filed Apr. 23, 2020; and published Oct. 29, 2020 as Int'l Publ. No. WO2020/216863), which, in turn, claims priority to U.S. Provisional Patent Appl. 62/838,985 (filed Apr. 26, 2019). The entire text of each of the above-referenced patent applications is incorporated by reference into this patent.

FIELD OF THE INVENTION

The invention relates generally to the field of microbiology and the evolution of strains of *Bifidobacterium* and *Lactobacillus* with enhanced storage stability.

BACKGROUND OF THE INVENTION

A growing awareness of the relationship between diet and health has resulted in an increased demand for food products that are capable of enhancing the health as well as provide basic nutrition. Examples of such food products include probiotics.

The term probiotic, meaning "for-life", is derived from Greek which already indicates the most essential properties of probiotic cultures. The term probiotic was first used by Lilly and Stillwell, 1965 to describe "substances secreted by one micro-organism which stimulate the growth of another" and thus contrasted by the term antibiotic (Lilly and Stillwell, 1965). It may be because of this positive and general claim of the definition that the term probiotic was subsequently applied to other subjects and gained a more general meaning. Now the definition of the term refers to "viable bacteria that beneficially influence the health of the host".

Different studies have demonstrated that the average human and animal gut contains about 100 different species of bacteria, including 'probiotic' bacteria, such as for example bacteria belonging to the genera *Lactococcus, Streptococcus, Pediococcus, Enterococcus, Leuconostoc, Carnobacterium, Propionibacterium, Lactobacillus* and *Bifidobacterium*.

Regular consumption of 'probiotic' bacteria has been reported to enhance gastrointestinal tract function and stability, improve protection against infection and carcinogenic mutagens, bolster the immune system, alleviate lactic acid intolerance, improve digestion and nutrient absorption, reduce blood cholesterol and reduce risks to allergies and wheat intolerance.

Probiotic bacterial cultures are today found in a wide range of products for consumption such as dairy products and different emulsions such as oil-in-water products and water-in-oil products. Incorporation of probiotics into such formulations is particularly fraught with difficulties, because of the harsh processing conditions.

Probiotic cultures encounter a variety of stresses during manufacturing and subsequent storage. During the manufacturing process, probiotics can be exposed to cold, heat, osmotic, oxidative, and acid stress (Upadrasta et al. 2011). The stresses associated with lyophilization or spray drying primarily lead to lethal damage in the cellular membrane, but also affect the cell wall, ribosomes, and DNA/RNA (Castro et al. 1997, Simpson et al. 2005, Mills et al. 2011). Depending on the storage conditions, it is not unusual to see loss of viable cell counts (determined as colony forming units (CFU)) exceed 90% over a storage time of 2 years.

To mitigate the storage losses, many probiotic manufacturers add more live cells into their products at the time of production ("overage"), in order to ensure the number of live cells at the end of storage (at specified storage conditions) are still above the label claim of the product. Strains with increased storage stability allow for incorporation of fewer viable cells per product at time of production, and the products still comply or exceed the storage label claims at end of storage. The reduced number of cells (i.e. a lower "overage") in turn result in the reduction of fermentation capacity required to produce the same amount of product, and ultimately in a significantly increased profitability of the process. Moreover, often the application form, e.g. a pill, cannot exceed a certain maximum size thereby limiting the amount of overage that can be applied. Therefore, the feasibility of commercializing a strain critically depends on its storage stability in order to provide desired viable cell numbers over its product life.

A growing body of evidence suggests that physiological changes induced by stress before storage can improve the storage stability, measured as the number of viable cells (CFUs) after storage. Exposure of *Lactobacillus rhamnosus* (HN001) to stressful levels of either heat or salt prior to storage correlated with significant improvement in storage stability compared to non-stressed control cultures (Prasad et al. 2003). NaCl stress during late growth phase improved the freeze-dried survival of *Lactobacillus bulgaricus*, while fermentation of *Lactobacillus reuteri* at high temperatures and high pHs improved the survival of cells post freeze-drying (Li et al. 2014, Liu et al. 2014a). The changes in pH and temperature induced modifications in the composition of the cell membrane that seemed to improve viability of the cells following freeze-drying (Liu et al. 2014b). Pre-exposure of probiotic bacteria to heat, acid, bile, oxygen, and $H_2O_2$ have all led to enhanced survival during drying (Upadrasta et al. 2011). Similarly, U.S. Pat. No. 5,728,574 teaches a method for improving viability of dried *Pseudomonas fluorescens* consisting of limiting nitrogen sources during fermentation and then leaving the strain in stationary phase for at least 6 hrs. Heat shock prior to drying was applied to achieve further improvement.

The present invention sets itself apart from afore mentioned prior art by generating and selecting cells with increased storage stability based on genetic changes and not due to physiological changes. The mutations underlying this improved heritable phenotype can be identified via whole genome sequence analysis.

U.S. 8,741,622 teaches that natural selection through multiple cycles of heat-shock treatment followed by a growing step at benign conditions to isolate more heat-shock-stable strains. Using the same approach, (Kulkarni et al. 2018) were able to obtain *L. acidophilus* strains with higher survival during heat-shock treatment and storage over seven days. In each of these above mentioned reports strains were exposed to stress for relatively short periods of time. No effort was made to understand the genetic basis for the increased viability or to determine if this characteristic was a stable and heritable phenotype.

Studies have suggested that there is a genetic basis for linking those strains having increased tolerance to various stresses and increased storage stability. For example, in a set of different Bifidobacteria species Simpson et al. observed a correlation between their intrinsic tolerance to heat or oxygen stress and their viability after storage (Simpson et al. 2005). In the presented teaching the surprising finding is exploited that a population of cells grown under continuous temperature stress at the same time also increases the fraction of cells in said population that exhibit improved storage stability properties. These studies are intriguing however were not able to elucidate the genetic changes that we associated with improved storage stability.

The problem to be solved therefore is to uncover the genetic basis for storage stability as it applies to bacterial cultures in general and those with probiotic specificity in particular so as to provide the industry with a reproducible basis for enhancing storage stability and reducing the costs associated with overages in dose. Additionally there is a need to develop selection and screening means to identify the relevant evolved strains that have good manufacturing properties in combination with improved storage stability.

SUMMARY OF THE INVENTION

The invention addresses the stated challenges by providing experimentally evolved strains of Bifidobacterium and Lactobacillus that demonstrate enhanced storage stability based on genetic changes and not physiological changes where the cells are grown under conditions of continuous exposure to stress.

Accordingly the invention provides a heat evolved strain of Bifidobacterium wherein the strain has at least one mutation selected from the group consisting of:
  a) at least one mutation in the gene encoding a Polyribonucleotide nucleotidyltransferase;
  b) at least one mutation in the CheY-like receiver domain;
  c) at least one mutation in the gene encoding a SSU ribosomal protein;
  d) at least one mutation in the intergenic regions upstream of the gene encoding a Oleate hydratase and downstream of the gene encoding a Phosphoglycerate mutase;
  e) at least one mutation in the gene encoding a Pup ligase PafA' paralog;
  f) at least one mutation in the gene encoding a UTP-glucose-1-phosphate uridylyltransferase;
  g) at least one mutation in the gene encoding an Arginine/ornithine antiporter ArcD; and
  h) at least one mutation in the gene encoding a Pyridoxine biosynthesis glutamine am idotransferase,
  wherein the mutations described in parts a)-h) are as compared with the genome sequence of the ancestral strain as set forth in SEQ ID 1, and
  wherein the evolved strain has greater storage stability or effective productivity as compared with the ancestral strain (Bi-07, ATCC PTA SD5220).

In another embodiment the invention provides a heat evolved strain of Bifidobacterium animalis subsp. lactis deposited with the DSMZ under number DSM 33461 on 4 Mar. 2020 (BBi 6.6).

In another embodiment the invention provides a heat evolved strain of Lactobacillus acidophilus NCFM wherein the strain has at least one mutation selected from the group consisting of:
  a) at least one mutation in a gene that encodes a 30S ribosomal protein S18; (rpsR)
  b) at least one mutation in a gene that encodes a pyridoxal kinase (LBA1007)
  c) at least one mutation in a gene that encodes an ATPase; (clpC)
  d) at least one mutation in a gene that encodes a gnt transcriptional regulator; (gntR) and
  e) at least one mutation in an intergenic region that affects the expression of the gene encoding uridine monophosphate kinase; (LAB1268);
  f) at least one mutation in a gene encoding a cation transporter (LBA0098); and
  g) at least one mutation in a gene encoding a transposase (LBA0127);
  wherein the mutations of a)-g) are as compared with the genome sequence of the parental strain (Lactobacillus acidophilus NCFM, ATCC 700396), SEQ ID NO:2; and wherein the evolved strain has greater storage stability as compared with the parental strain (Lactobacillus acidophilus NCFM, ATCC 700396).

In another embodiment the invention provides an evolved strain of Lactobacillus acidophilus deposited with the DSMZ under number DSM 33463 on 4 Mar. 2020 (NCFM 6.3).

In another embodiment the invention provides an NaCl evolved strain of Bifidobacterium animalis subsp. lactis wherein the strain has at least one mutation selected from the group consisting of:
  a) at least one mutation in a gene encoding a class II Fructose-bisphosphate aldolase;
  b) at least one mutation in a gene encoding a first hypothetical protein;
  c) at least one mutation in a gene encoding a putative ABC transporter integral membrane protein;
  d) at least one mutation in a gene encoding a KH domain RNA binding protein (YlqC);
  e) at least one mutation in a gene encoding a Regulator of polyketide synthase;
  f) at least one mutation in a gene encoding an ABC transporter ATP-binding protein;
  g) at least one mutation in a gene encoding a Putative esterase;
  h) at least one mutation in a gene encoding a Signal transduction histidine kinase;
  i) at least one mutation in a gene encoding an ABC-type amino acid transport system, permease component;
  j) at least one mutation in a gene encoding a Histidinol-phosphate aminotransferase;
  k) at least one mutation in gene encoding a DNA-directed RNA polymerase beta subunit;
  l) at least one mutation in a gene encoding a second hypothetical protein;
  m) at least one mutation in a gene encoding an Arginyl-tRNA synthetase; and
  n) at least one mutation in a gene encoding a third hypothetical protein.

In another embodiment the invention provides a NaCl evolved strain of Bifidobacterium animalis subsp. lactis deposited with the DSMZ under number DSM 33462 on 4 Mar. 2020 (BBi 2.7).

In another embodiment the invention provides a salt evolved strain of Bifidobacterium animalis subsp. lactis wherein the strain has at least one mutation selected from the group consisting of:
  a) a mutation in a gene encoding an SSU ribosomal protein S5p (S2e) wherein the mutation is a change from C to T at position 477512;
  b) a mutation in the intergenic region downstream of a gene encoding a Phosphoglycerate mutase and upstream of a gene encoding a Oleate hydratease where the mutation is a change from C to A at position 530981;

c) a mutation in a gene encoding a Pantothenate kinase type III (CoaX-like) wherein the nutation is a change from G to A at position 660753;

d) a mutation in a gene encoding an Argininosuccinate synthase wherein the mutation is a change from C to T at position 857663;

e) a mutation in the intergenic region downstream of a tRNA-Asn-Gtt and upstream of a gene encoding a hypothetical protein wherein the mutation is a change from G to A at position 895939;

f) a mutation in a gene encoding a putative glucose uptake permease wherein the mutation is a change from G to A at position 1259521;

g) a mutation in a gene encoding an Arginine/ornithine antiporter (ArcD) wherein the mutation is a change from C to T at position 1480689;

h) a mutation in a gene encoding a Pyridoxine biosynthesis glutamine amidotransferase, glutaminase subunit wherein the mutation is a change from T to C at position 1639044;

wherein the position given in parts a)-n) are with respect to the ancestral genome sequence SEQ ID NO:1.

In another embodiment the invention provides a method for the evolution and identification of a probiotic strain exhibiting at least one beneficial phenotype comprising:

a) providing a culture of an ancestral probiotic strain which has the ability to undergo natural genetic changes which lead to an increase in genetic diversity;

b) subjecting the culture of step a) to evolutionary pressure over multiple generations thereby increasing the frequency of mutations linked to the beneficial phenotype as compared with the ancestral strain; and c) subjecting the culture of step b) to a selection process to isolate the evolved strain; wherein the evolved strain continues to have probiotic efficacy.

BRIEF DESCRIPTION OF THE FIGURES BIOLOGICAL DEPOSITS AND SEQUENCE DESCRIPTIONS

Applicant have made the following biological deposits for the Purposes of Patent Procedure under the terms of the Budapest Treaty on the International Recognition of the Deposit of Microorganisms at the Leibniz-Institut Deutsche Sammlung von Mikroorganismen and Zellkulturen GmbH (DSMZ), Inhoffenstrasse 7B, 38124 Braunschweig, Germany:

| Depositor Identification Reference | Accession number given by the International Depository authority (DSMZ) | Date of Deposit |
|---|---|---|
| *Bifidobacterium* Bi-07 Heat 6.6 (DGCC13338) | DSM 33461 | 4 Mar. 2020 |
| *Bifidobacterium* Salt NaCl 2.7 (DGCC13339) | DSM 33462 | 4 Mar. 2020 |
| *Lactobacillus acidophilus* NCFM Heat 6.3 (DGCC13269) | DSM 33463 | 4 Mar. 2020 |

It is requested that the biological material shall be made available only by the issue of a sample to an expert nominated by the requester.

Figure 7:
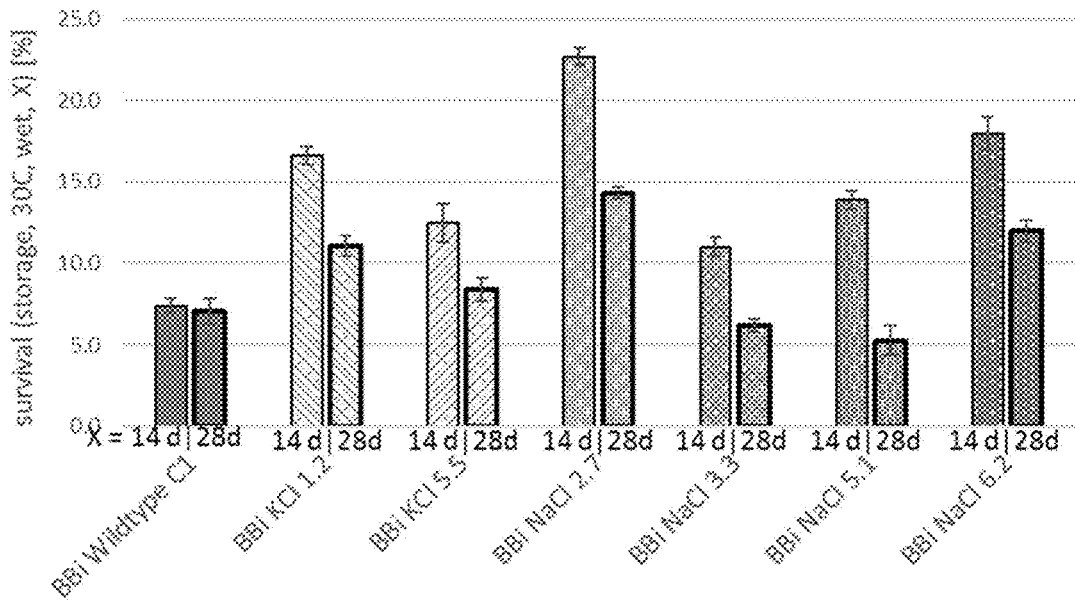

FIG. 7 is a graph showing the survival of cells BBi Wildtype C1 (solid dark grey), BBi KCl 1.2 (diagonal stripes downward), BBi KCl 5.5 (diagonal stripes upward), BBi NaCl 2.7 (50% dotted), BBi NaCl 3.3 (60% dotted), BBi NaCl 5.1 (70% dotted) and BBi NaCl 6.2 (80% dotted) in percent of cells before storage ("T0"), if stored at 30° C. and 40% relative humidity for either X=14 d (thin border) or X=28 d (thick border).

Figure 8:
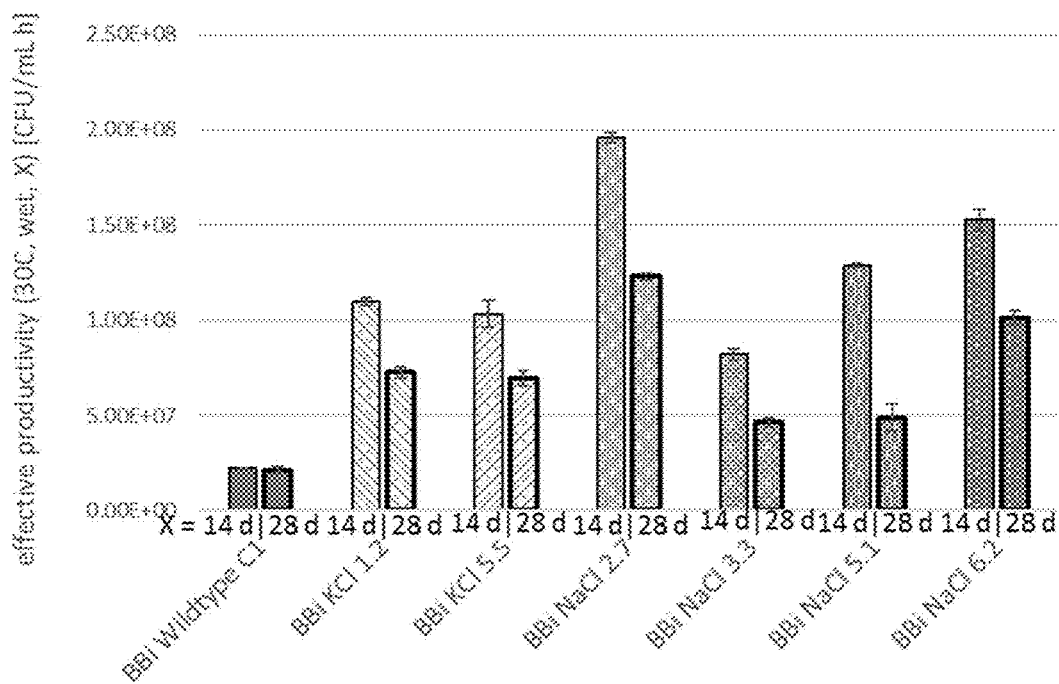

FIG. 8 is a graph showing the effective productivity of cultures BBi Wildtype C1 (solid dark grey), BBi KCl 1.2 (diagonal stripes downward), BBi KCl 5.5 (diagonal stripes upward), BBi NaCl 2.7 (50% dotted), BBi NaCl 3.3 (60% dotted), BBi NaCl 5.1 (70% dotted) and BBi NaCl 6.2 (80% dotted) if subsequently stored for either X=14 d (thin border) or X=28 d (thick border) at 30 C and 40% relative humidity.

Figure 9:
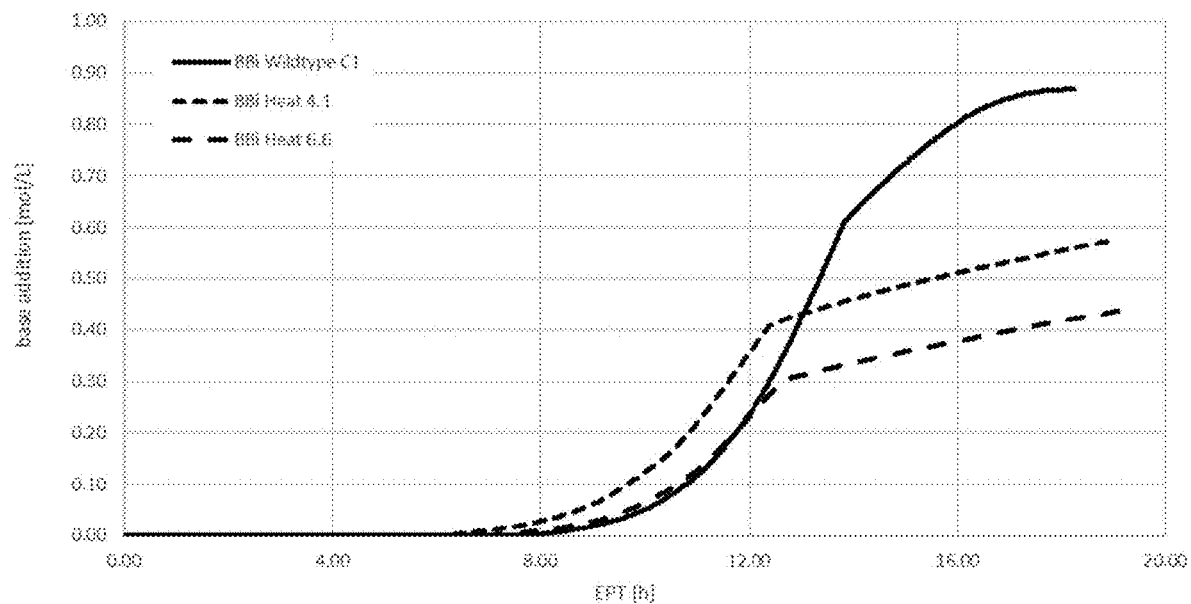

FIG. 9 is a graph showing a time course of cumulative base addition for BBi Wildtype C1 (solid line), BBi Heat 4.1 (line with short dashes) and BBi Heat 6.6. (line with long dashes) cultures.

Figure 10:
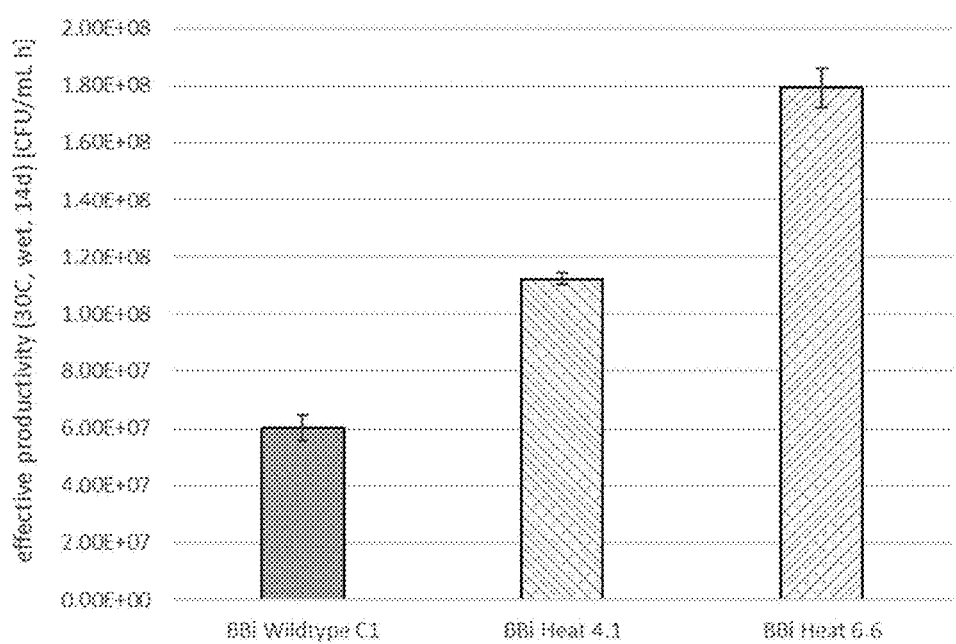

FIG. 10 is a graph showing the effective productivity of cultures BBi Wildtype C1 (solid grey), BBi Heat 4.1 (diagonal stripes downward) and BBi Heat 6.6 (diagonal stripes upward) if subsequently stored at 30° C. and 40% relative humidity for 14 d.

Figure 11:
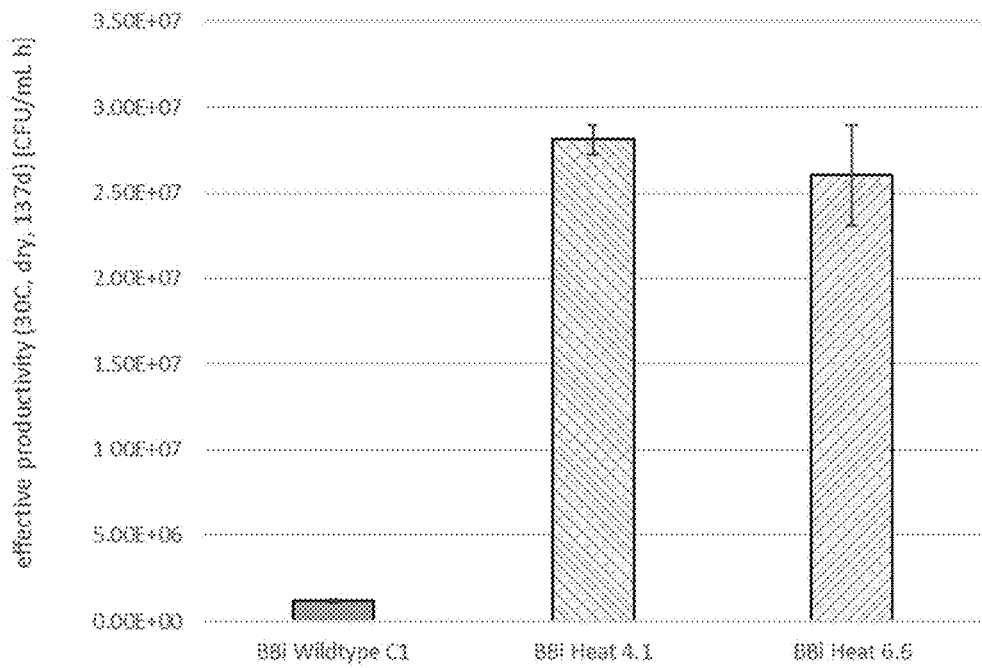

FIG. 11 is a graph showing the effective productivity of cultures BBi Wildtype C1 (solid grey), BBi Heat 4.1 (diagonal stripes downward) and BBi Heat 6.6 (diagonal stripes upward) if subsequently stored at 30° C. and low relative humidity for 137 d.

Figure 12:
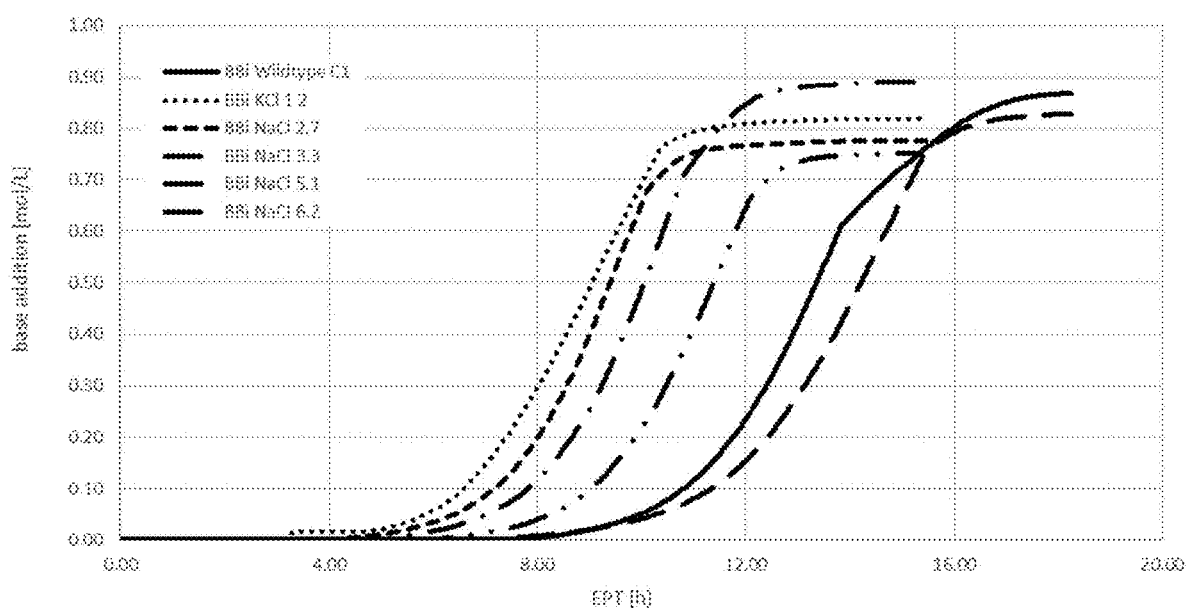

FIG. 12 is a graph showing a time course of cumulative base addition for BBi Wildtype C1 (solid line), BBi KCl 1.2 (dotted line), BBi NaCl 2.7 (line with short dashes), BBi NaCl 3.3 (line with long dashes), BBi NaCl 5.1 (line with long dash followed by two points) and BBi NaCl 6.2 (line with long dash followed by one point).

Figure 13:
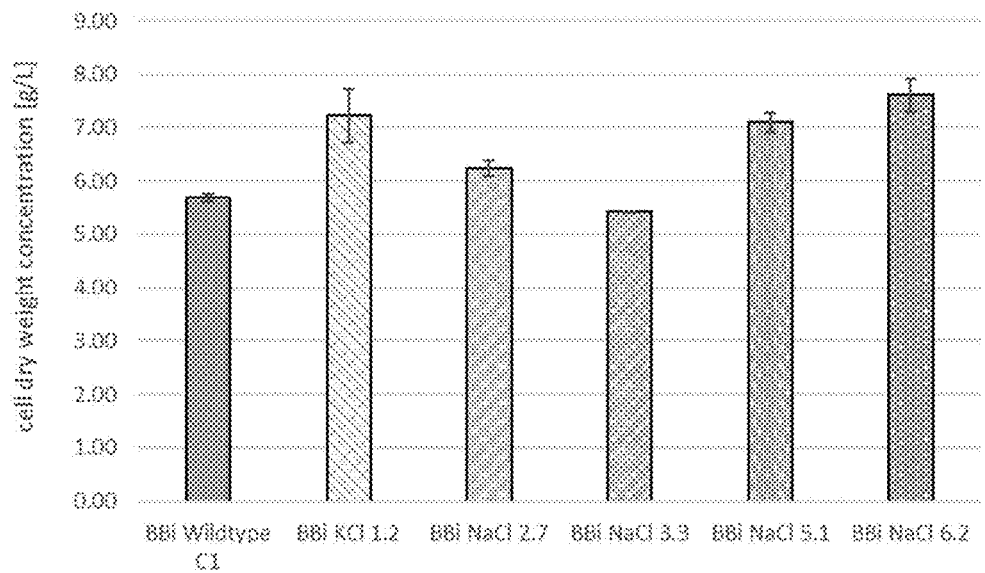

FIG. 13 is a graph showing cell dry weight concentration measured at harvest time in cultures of BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted)

Figure 14:
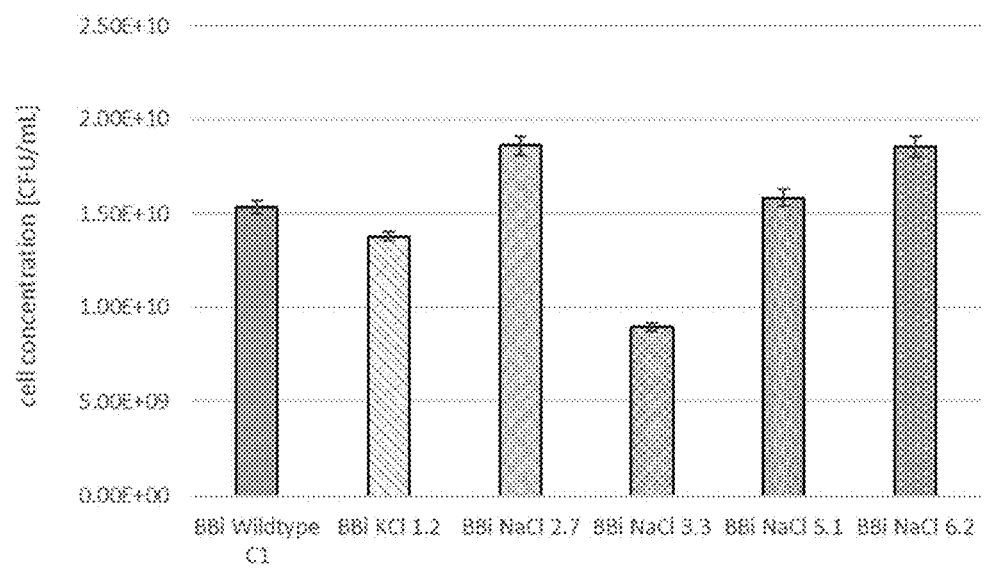

FIG. 14 is a graph of cell dry weight concentration measured at harvest time in cultures of BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted).

Figure 15:
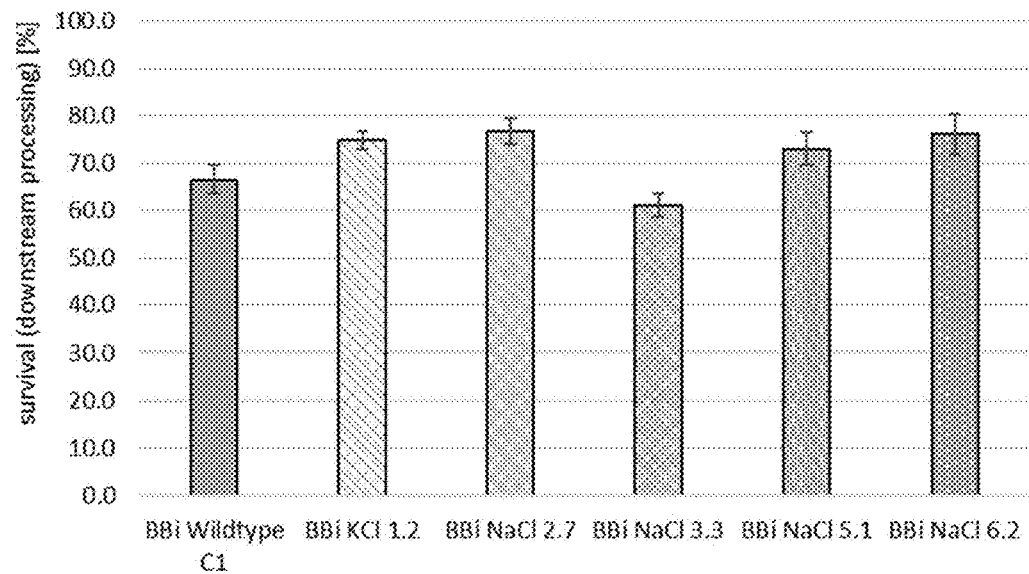

FIG. 15 is a graph showing the survival of cells after downstream processing in percent of cells from cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) as compared to fermentation cell numbers after conditioning (CN).

Figure 16:
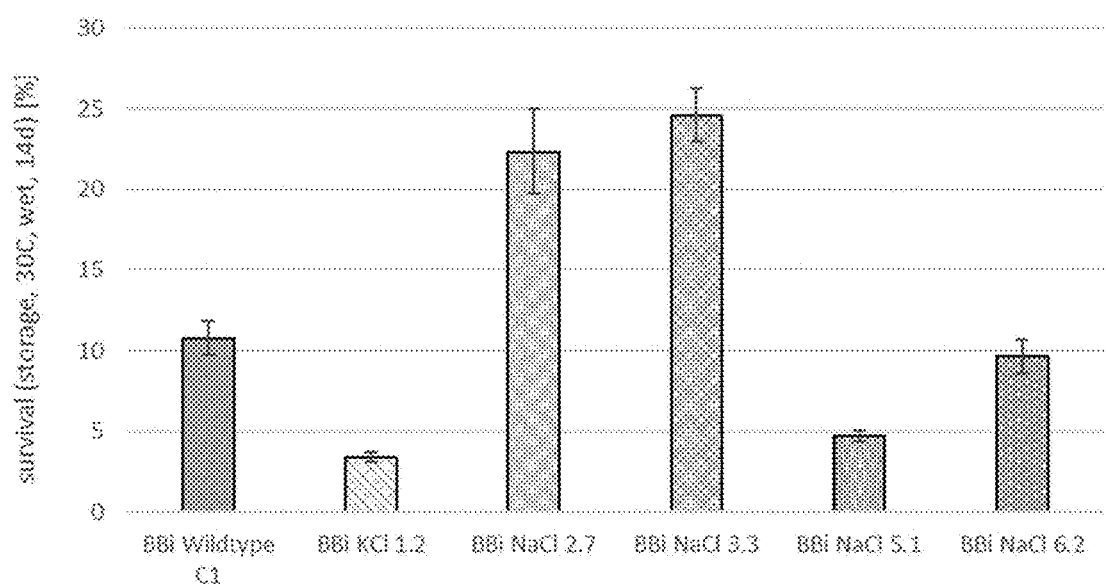

FIG. 16 is a graph of the survival of cells of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) in percent of cells before storage ("T0"), if stored at 30° C. and 40% relative humidity for 14 d.

Figure 17:
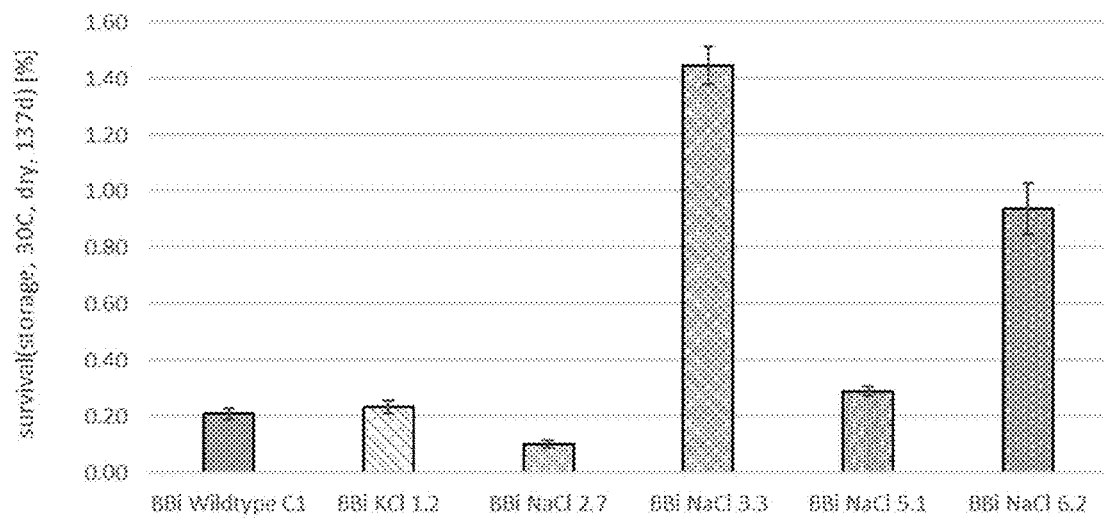

FIG. 17 is a graph showing the survival of cells of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) in percent of cells before storage ("T0"), if stored at 30° C. and low relative humidity for 137 d.

Figure 18:
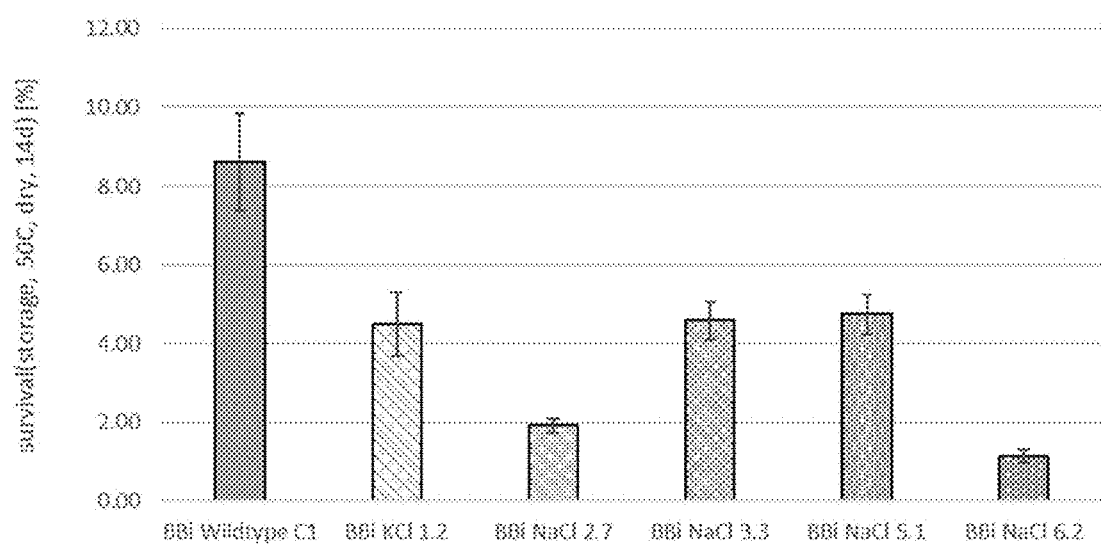

FIG. 18 is a graph showing the survival of cells of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) in percent of cells before storage ("T0"), if stored at 50° C. and low relative humidity for 14 d.

Figure 19:
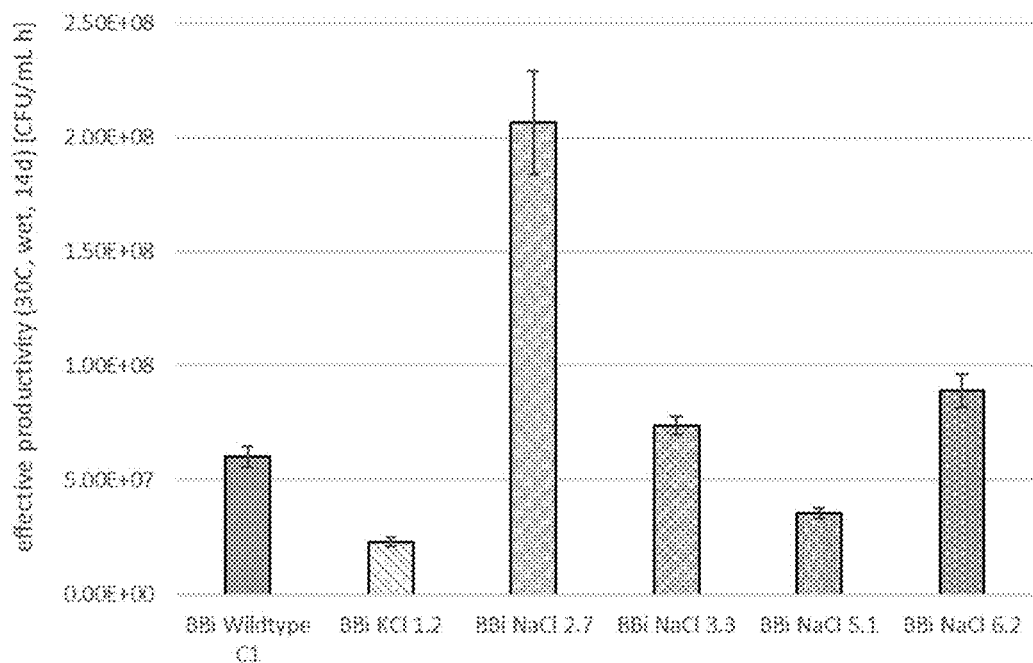

FIG. 19 is a graph showing the effective productivity of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) if subsequently stored at 30° C. and 40% relative humidity for 14 d.

Figure 20:
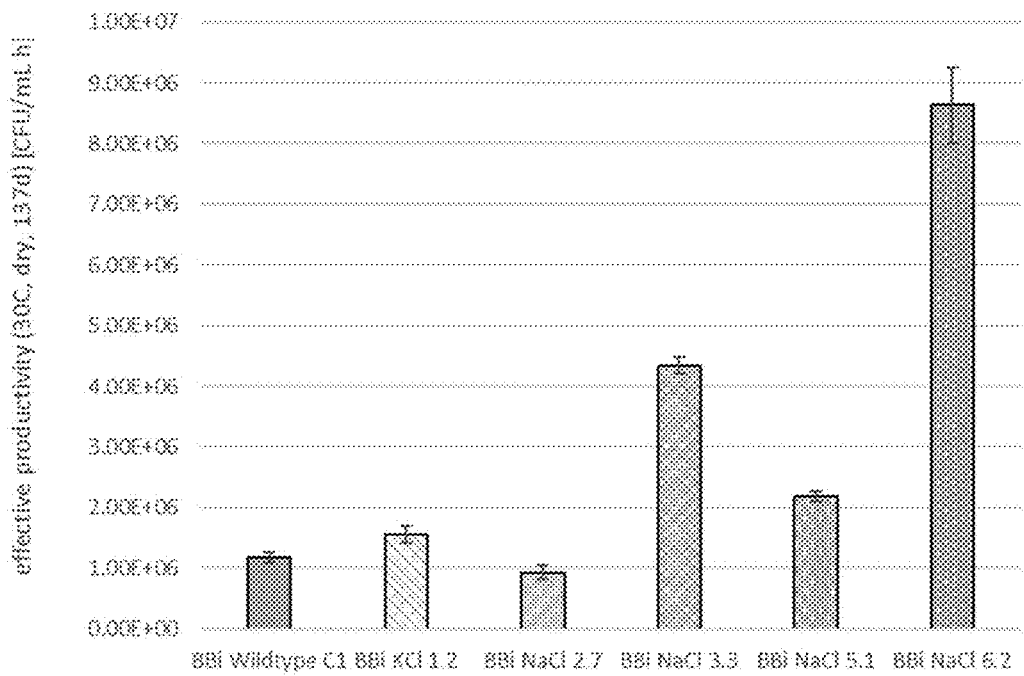

FIG. 20 is a graph showing the effective productivity of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) if subsequently stored at 30° C. and low relative humidity for 137 d.

Figure 21:
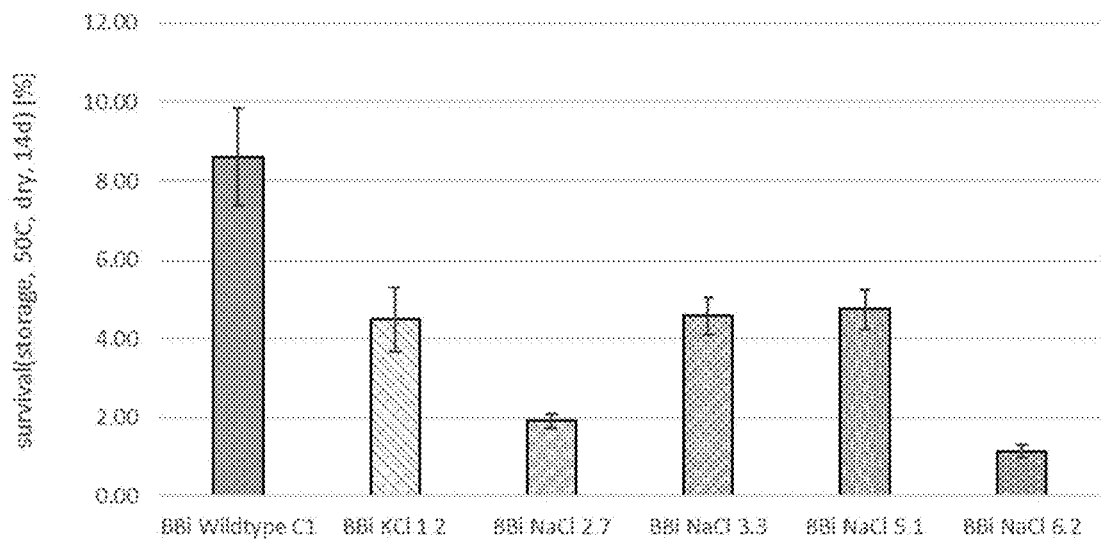

FIG. 21 is a graph showing the effective productivity of cultures BBi Wildtype C1 (solid grey), BBi KCl 1.2 (diagonal stripes downward), BBi NaCl 2.7 (50% dotted), BBi NaCl 3.3 (60% dotted), BBi NaCl 5.1 (70% dotted) and BBi NaCl 6.2 (80% dotted) if subsequently stored at 50° C. and low relative humidity for 14 d.

Figure 22:
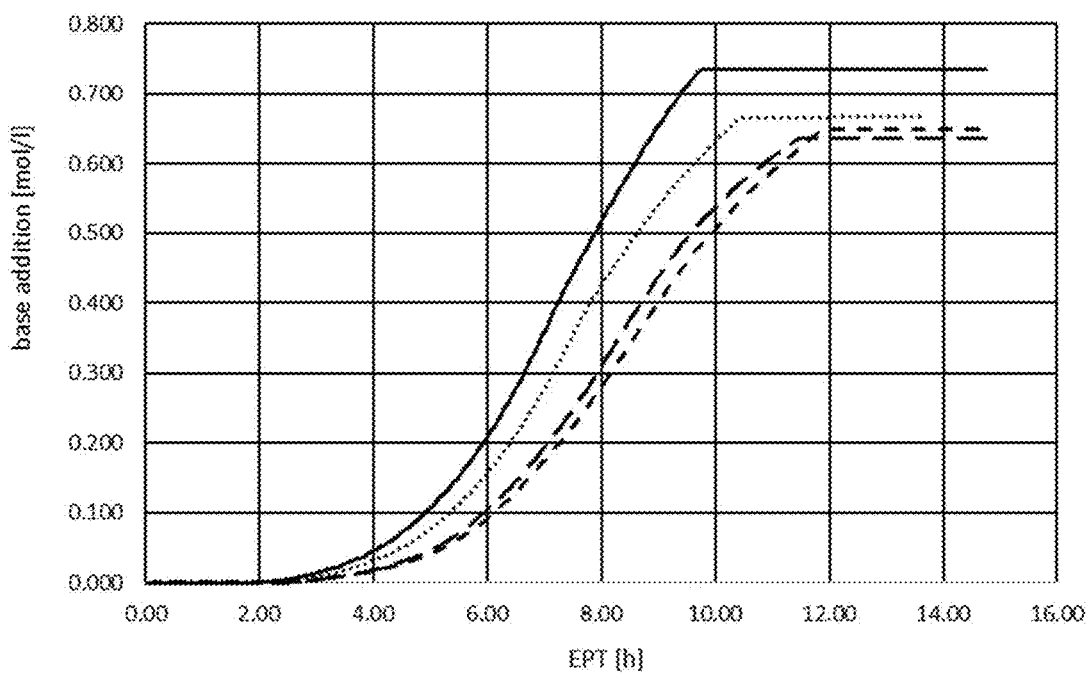

FIG. 22 is a graph showing a time course of cumulative base addition for NCFM Wildtype C1 (solid line), NCFM Wildtype C2 (dotted line), NCFM Heat 1.1 (line with long dashes) and NCFM Heat 6.3. (line with long dashes) cultures.

Figure 23:
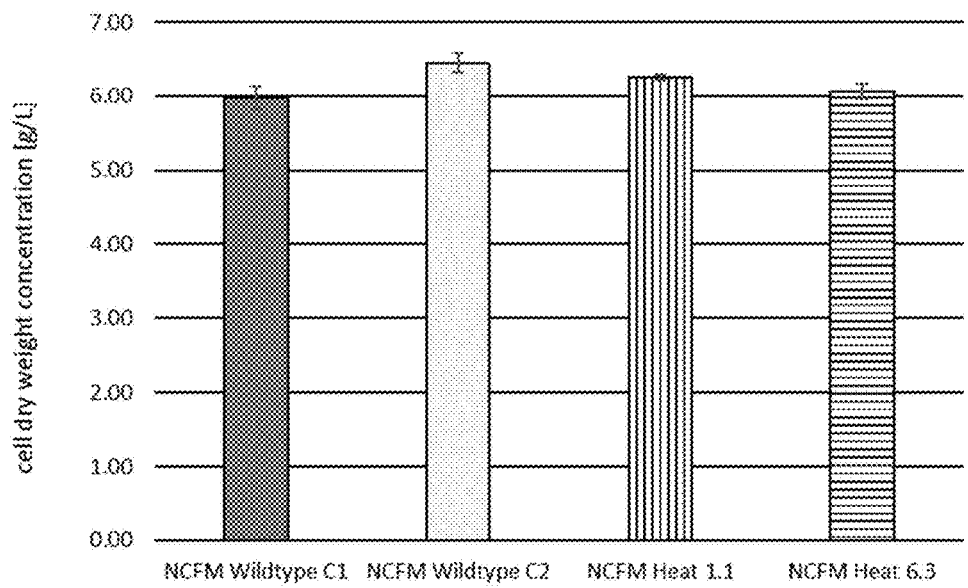

FIG. 23 is a graph showing cell dry weight concentration measured at harvest time in cultures of NCFM Wildtype C1 (solid grey), NCFM Wildtype C2 (solid light grey), NCFM Heat 1.1 (vertical stripes) and NCFM Heat 6.3 (horizontal stripes).

Figure 24:
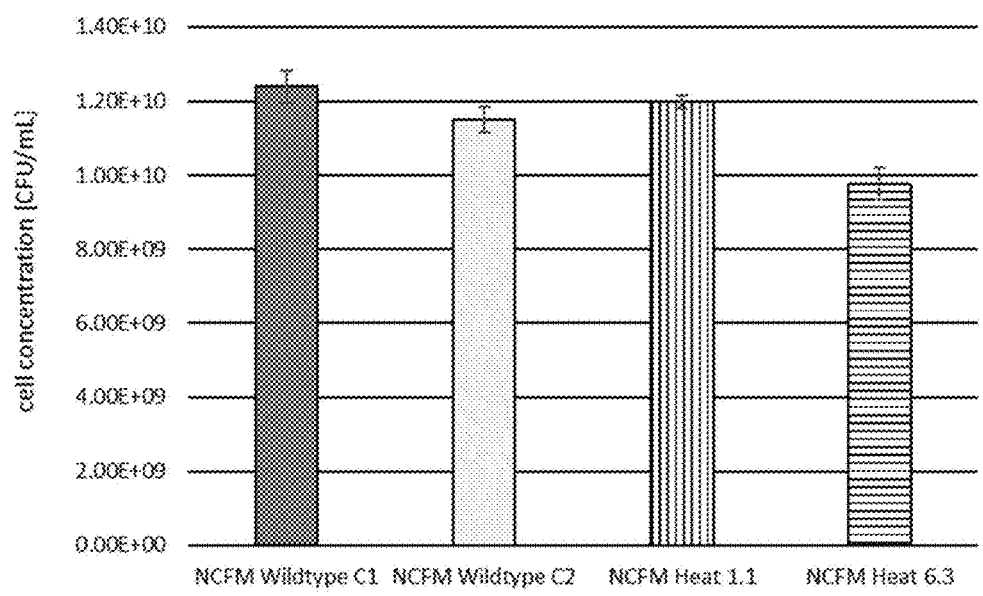

FIG. 24 is a graph showing cell concentration at harvest time and subsequent storage for 1 h at 10 C in cultures of NCFM Wildtype C1 (solid grey), NCFM Wildtype C2 (solid light grey), NCFM Heat 1.1 (vertical stripes) and NCFM Heat 6.3 (horizontal stripes).

Figure 25:
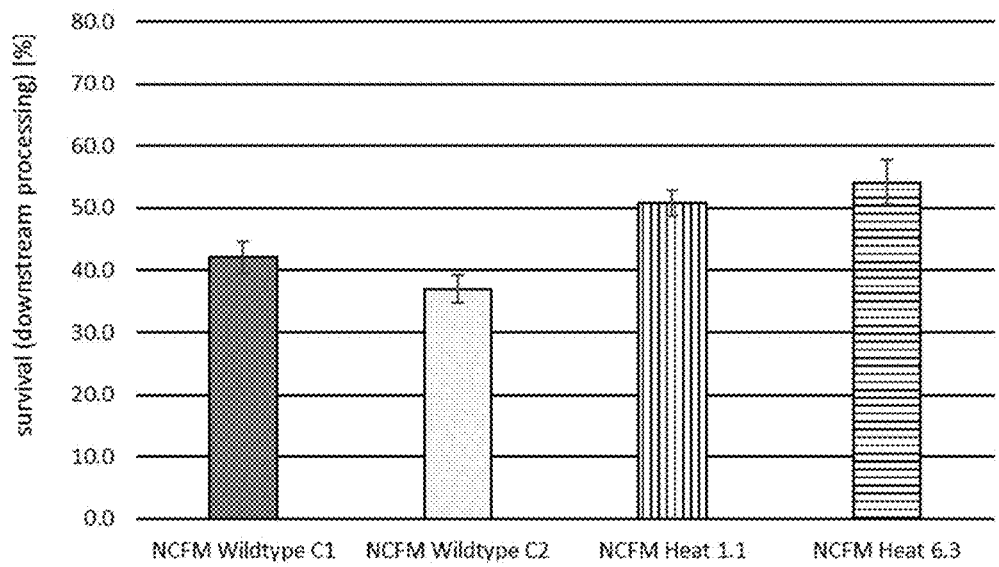

FIG. 25 is a graph showing survival of cells after downstream processing in percent of cells from cultures NCFM Wildtype C1 (solid grey), NCFM Wildtype C2 (solid light grey), NCFM Heat 1.1 (vertical stripes) and NCFM Heat 6.3 (horizontal stripes) as compared to fermentation cell numbers after conditioning (CN).

Figure 26:
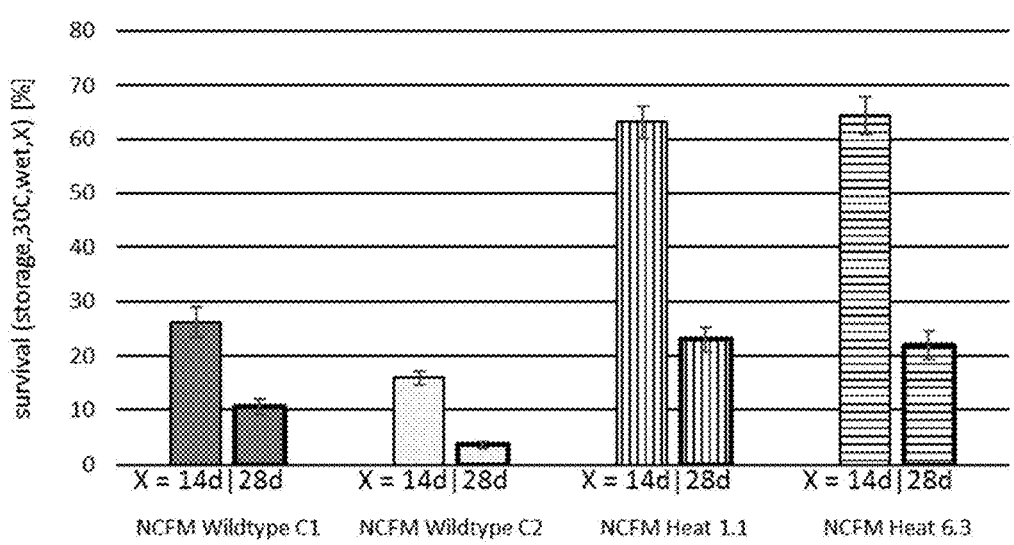

FIG. 26 is a graph showing survival of cells of cultures NCFM Wildtype C1 (solid grey), NCFM Wildtype C2 (light grey), NCFM Heat 1.1 (vertical lines) and NCFM Heat 6.3 (horizontal lines) after 14 d (thin border) and 28 d (thick border) in percent of cells before storage ("T0"), if stored at 30° C. and 40% relative humidity.

Figure 27:
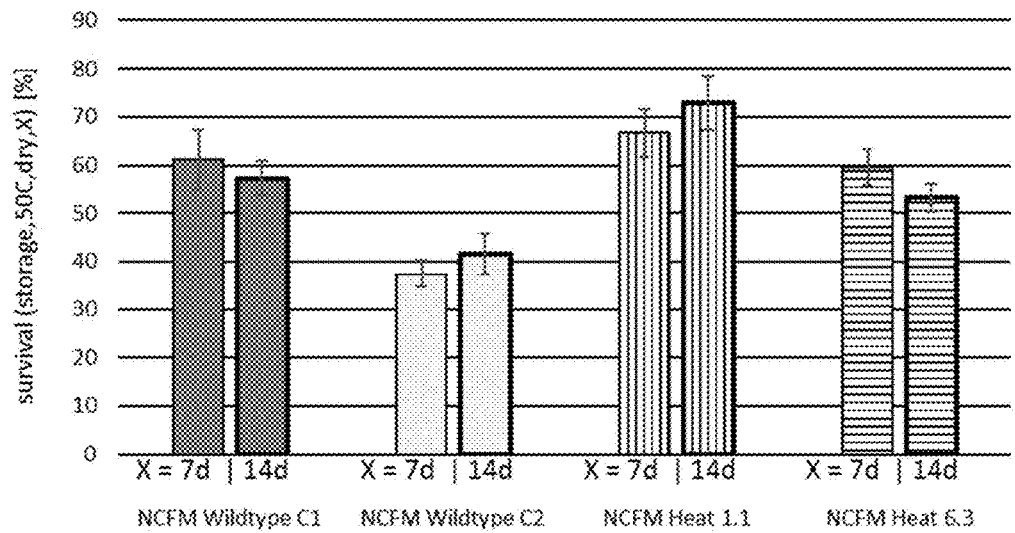

FIG. 27 is a graph showing survival of cells of cultures NCFM Wildtype C1 (solid dark grey), NCFM Wildtype C2 (solid light grey), NCFM Heat 1.1 (vertical lines) and NCFM Heat 6.3 (horizontal lines) after 7 d (thin border) and 14 d (thick border) in percent of cells before storage ("T0"), if stored at 50° C. and low relative humidity.

Figure 28:
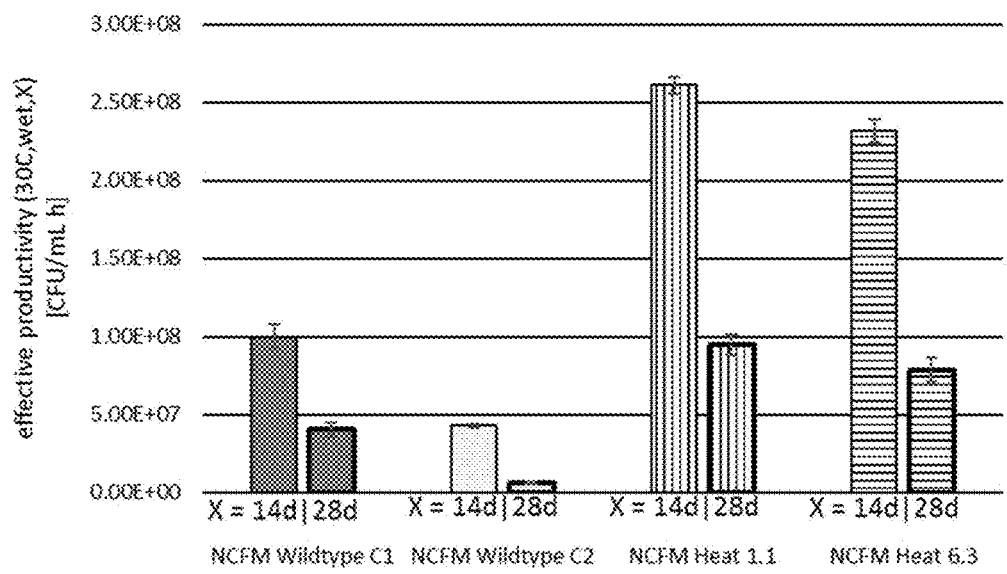

FIG. 28 is a graph showing effective productivity of cultures NCFM Wildtype C1 (solid dark grey), NCFM Wildtype C2 (solid light grey), NCFM Heat 1.1 (vertical lines) and NCFM Heat 6.3 (horizontal lines) if subsequently stored for either X=14 d (thin border) or X=28 d (thick border) at 30 C and 40% relative humidity.

Figure 29:
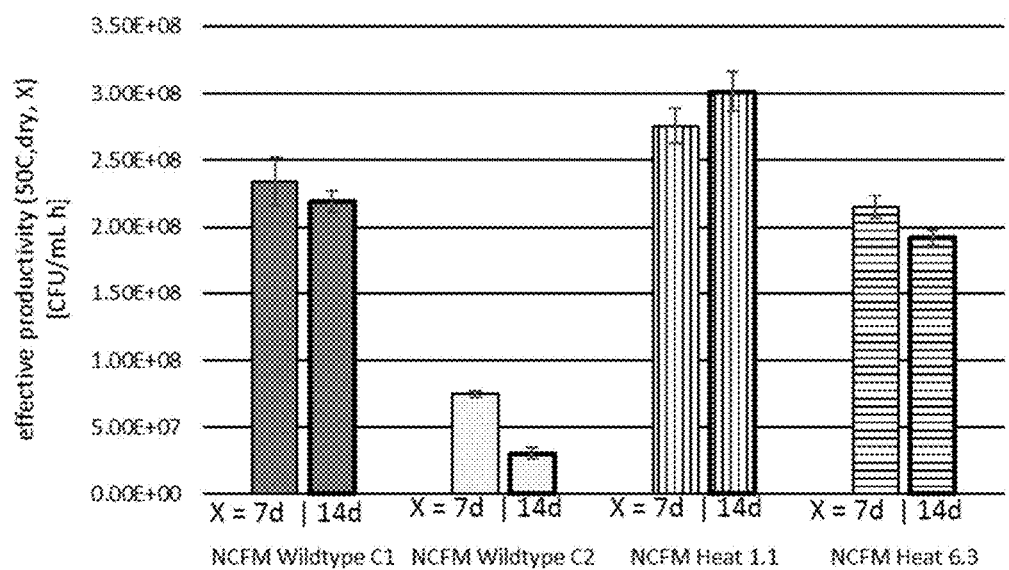

FIG. 29 is a graph showing effective productivity of cultures NCFM Wildtype C1 (solid dark grey), NCFM Wildtype C2 (solid light grey), NCFM Heat 1.1 (vertical lines) and NCFM Heat 6.3 (horizontal lines) if subsequently stored for either X=7 d (thin border) or X=14 d (thick border) at 50 C and low relative humidity.

Figure 30:
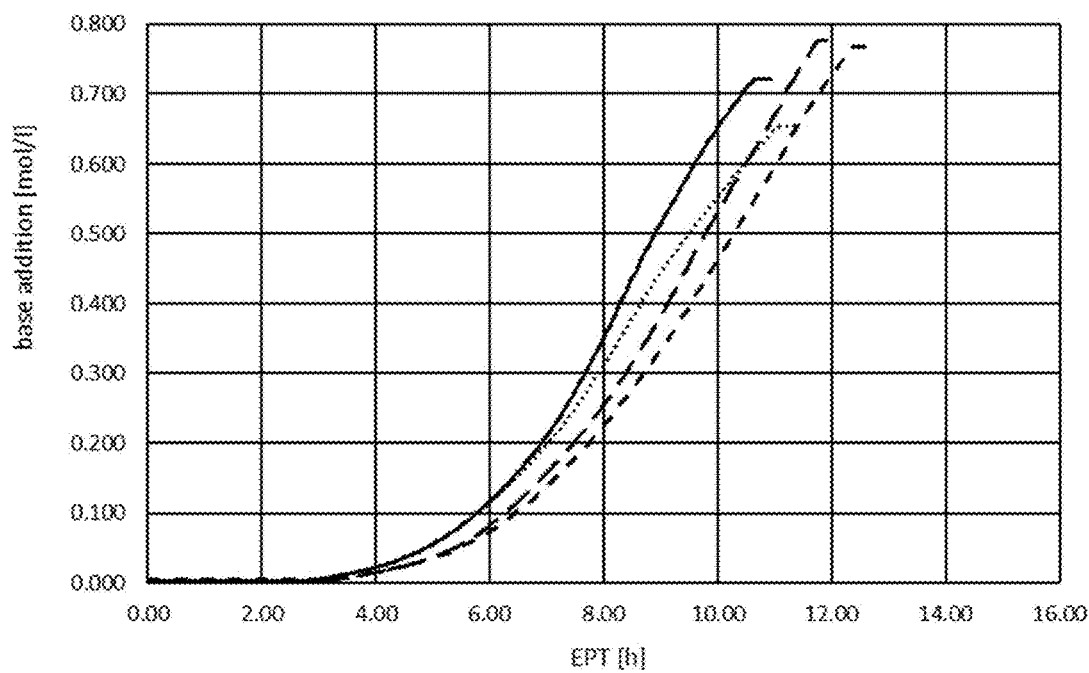

FIG. 30 is a graph showing a time course of cumulative base addition for NCFM Wildtype C1 (solid line), NCFM Wildtype C2 (dotted line), NCFM Heat 1.1 (line with long dashes) and NCFM Heat 6.3. (line with long dashes) cultures.

Figure 31:
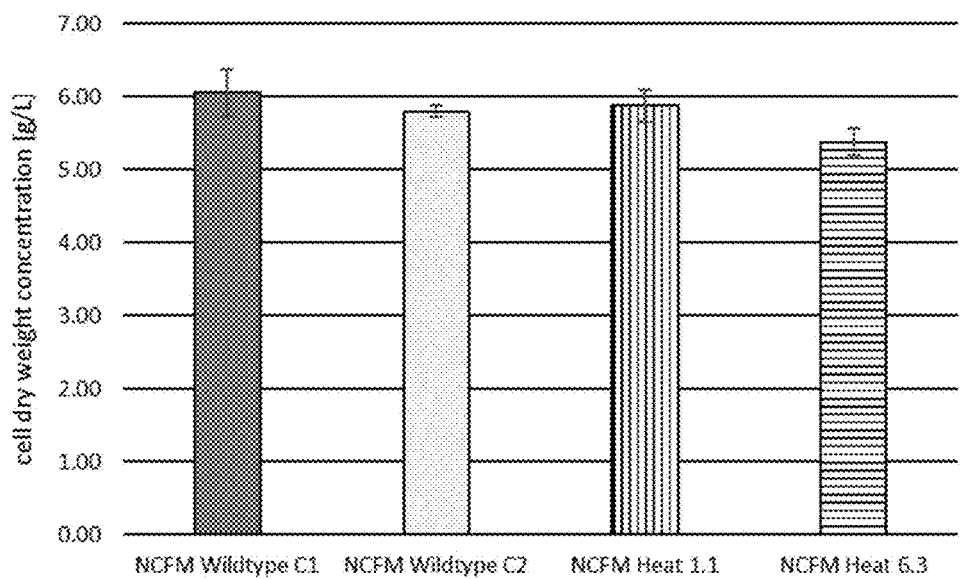

FIG. 31 is a graph showing cell dry weight concentration measured at harvest time in cultures of NCFM Wildtype C1 (solid grey), NCFM Wildtype C2 (solid light grey), NCFM Heat 1.1 (vertical stripes) and NCFM Heat 6.3 (horizontal stripes).

Figure 32:
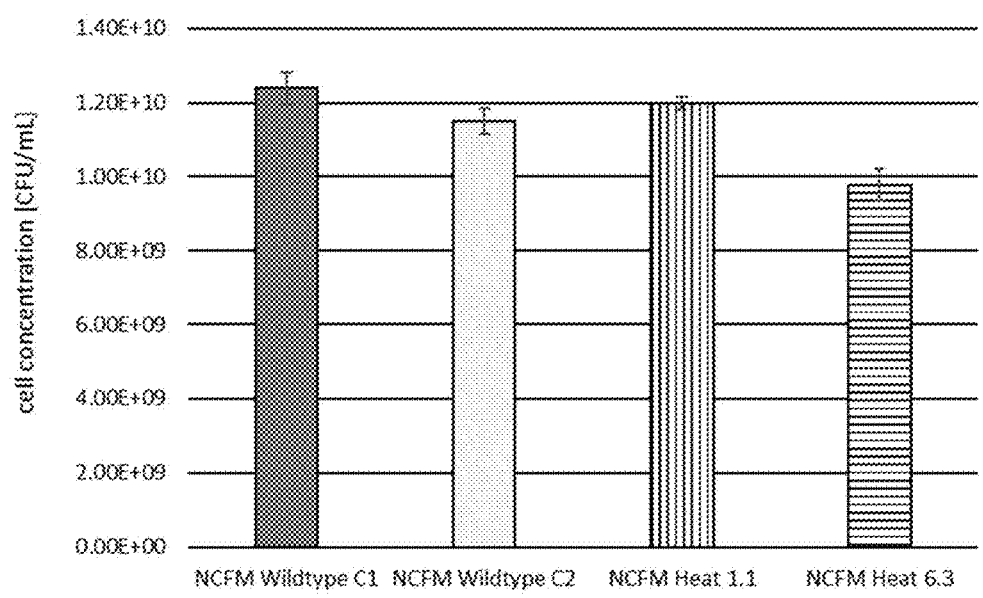

FIG. 32 is a graph showing cell concentration at harvest time and subsequent storage for 1 h at 10 C in cultures of NCFM Wildtype C1 (solid grey), NCFM Wildtype C2 (solid light grey), NCFM Heat 1.1 (vertical stripes) and NCFM Heat 6.3 (horizontal stripes).

Figure 33:
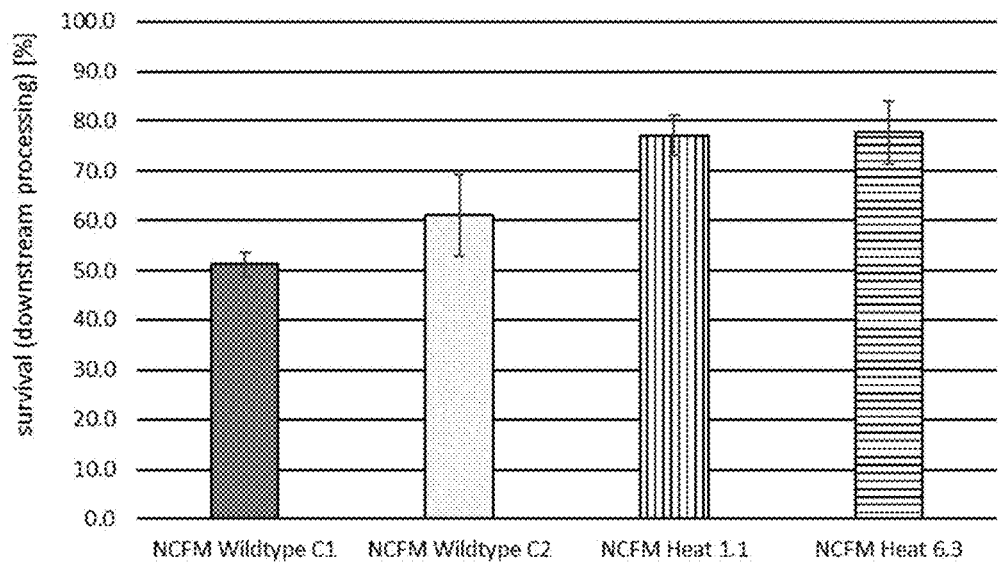

FIG. 33 is a graph showing survival of cells after downstream processing in percent of cells from cultures NCFM Wildtype C1 (solid grey), NCFM Wildtype C2 (solid light grey), NCFM Heat 1.1 (vertical stripes) and NCFM Heat 6.3 (horizontal stripes) as compared to fermentation cell numbers after conditioning (CN).

Figure 34:
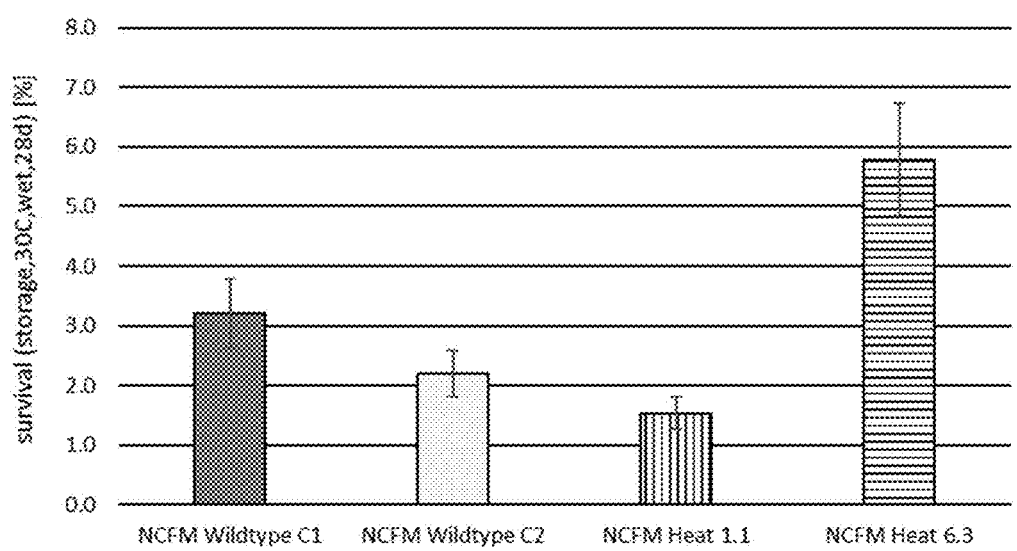

FIG. 34 is a graph showing survival of cells of cultures NCFM Wildtype C1 (solid grey), NCFM Wildtype C2 (light grey), NCFM Heat 1.1 (vertical lines) and NCFM Heat 6.3 (horizontal lines) in percent of cells before storage ("T0"), if stored for 28 d at 30° C. and 40% relative humidity.

Figure 35:
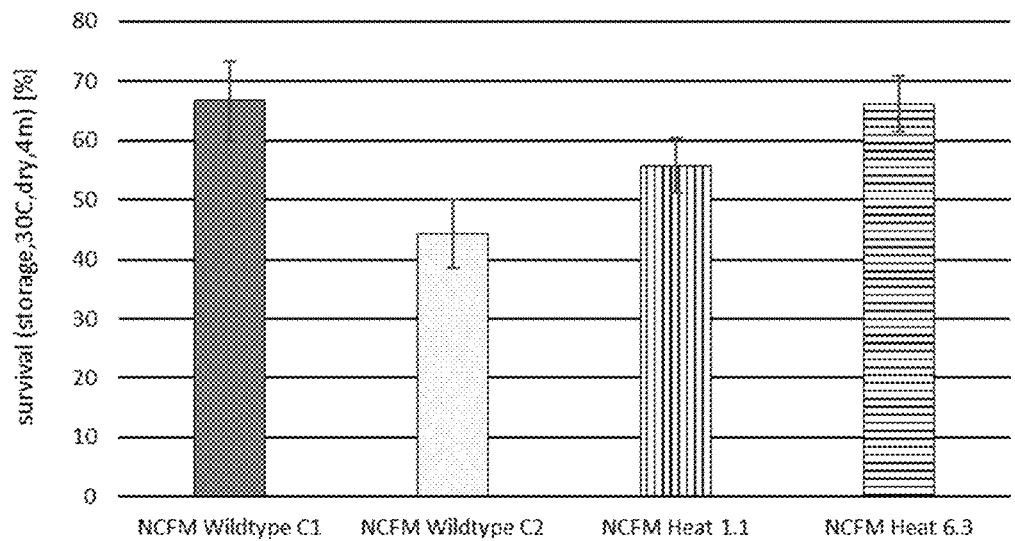

FIG. 35 is a graph showing survival of cells of cultures NCFM Wildtype C1 (solid dark grey), NCFM Wildtype C2 (solid light grey), NCFM Heat 1.1 (vertical lines) and NCFM Heat 6.3 (horizontal lines) in percent of cells before storage ("T0"), if stored for 4 m at 30° C. and low relative humidity.

Figure 36:
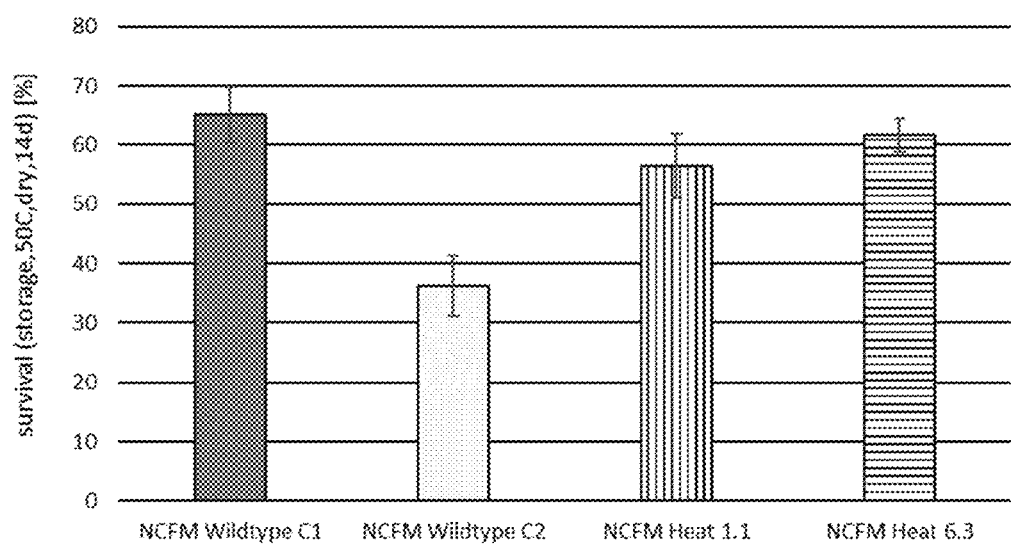

FIG. 36 is a graph showing survival of cells of cultures NCFM Wildtype C1 (solid dark grey), NCFM Wildtype C2 (solid light grey), NCFM Heat 1.1 (vertical lines) and NCFM Heat 6.3 (horizontal lines) in percent of cells before storage ("T0"), if stored for 14 d at 50° C. and low relative humidity.

Figure 37:
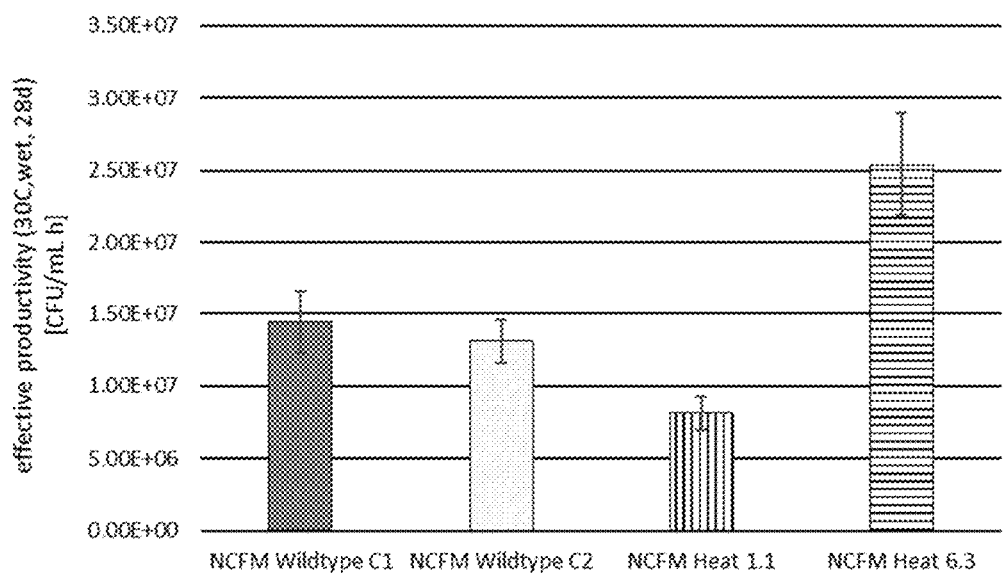

FIG. 37 is a graph showing effective productivity of cultures NCFM Wildtype C1 (solid dark grey), NCFM Wildtype C2 (solid light grey), NCFM Heat 1.1 (vertical lines) and NCFM Heat 6.3 (horizontal lines) if subsequently stored for 28 d at 30 C and 40% relative humidity.

Figure 38:
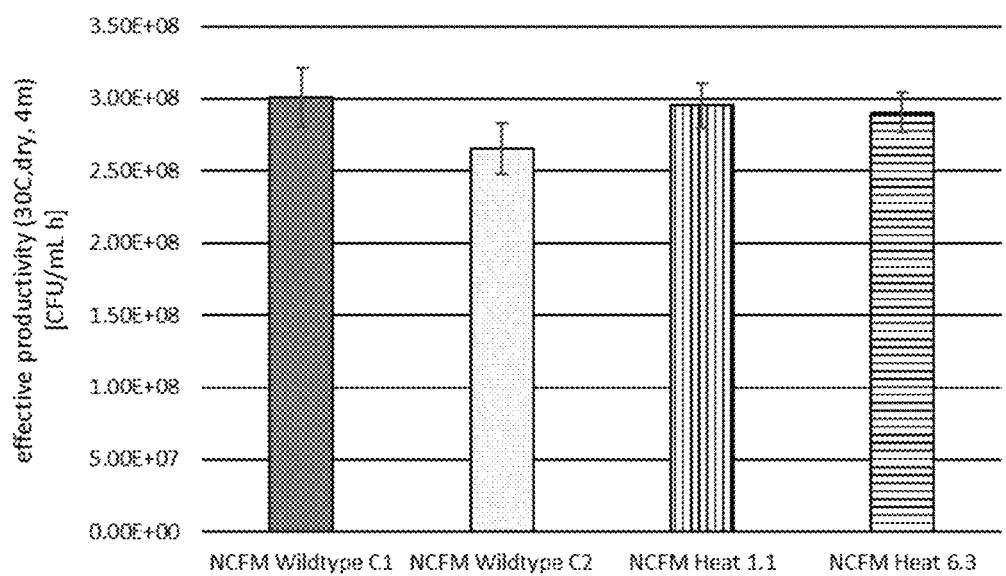

FIG. 38 is a graph showing effective productivity of cultures NCFM Wildtype C1 (solid dark grey), NCFM Wildtype C2 (solid light grey), NCFM Heat 1.1 (vertical lines) and NCFM Heat 6.3 (horizontal lines) if subsequently stored for 4 m at 30 C and low relative humidity.

Figure 39:
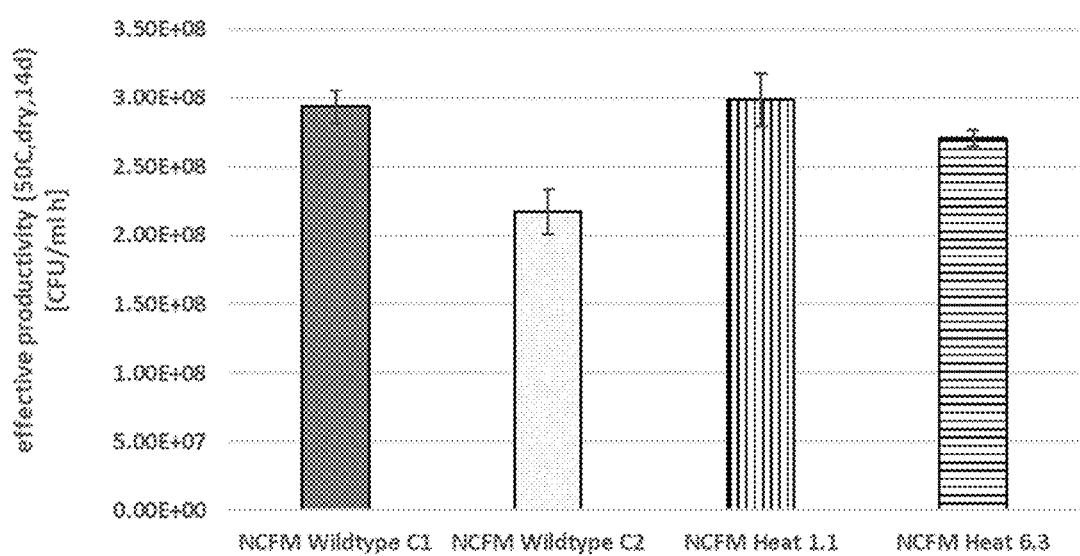

FIG. 39 is a graph showing effective productivity of cultures NCFM Wildtype C1 (solid dark grey), NCFM Wildtype C2 (solid light grey), NCFM Heat 1.1 (vertical lines) and NCFM Heat 6.3 (horizontal lines) if subsequently stored for 14 d at 50° C. and low relative humidity The following sequences comply with 37 C.F.R. § 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. § 1.822.

SEQ ID NO:1 is the nucleotide sequence of the genome of the ancestral strain, *Bifidobacterium animalis lactis*, Bi-07 corresponding to the Genbank accession number NC_017867.

SEQ ID NO: 2 is the nucleotide sequence of the genome of the ancestral strain *Lactobacillus acidophilus* NCFM® corresponding to the Genbank accession number NC_006814

SEQ ID NO:3 is the first portion of the genome sequence of the ancestral strain of *Lactobacillus paracasei*, Contig A.

SEQ ID NO:4 is the second portion of the genome sequence of the ancestral stain of *Lactobacillus paracasei*, Contig B.

SEQ ID NO:5 is the sequence of a plasmid residing in the genome of the ancestral stain of *Lactobacillus paracasei*.

DETAILED DESCRIPTION OF THE INVENTION

Unless defined otherwise, all technical and scientific terms used herein have the same meaning as commonly understood by one of ordinary skill in the art to which this disclosure belongs. Singleton, et al., DICTIONARY OF MICROBIOLOGY AND MOLECULAR BIOLOGY by Singleton and Sainsbury (Singleton and Sainsbury, 2006) and THE HARPER COLLINS DICTIONARY OF BIOLOGY by Hale and Marham, (Hale and Marham, 1991) provide one of skill with a general dictionary of many of the terms used in this disclosure.

This disclosure is not limited by the exemplary methods and materials disclosed herein, and any methods and materials similar or equivalent to those described herein can be used in the practice or testing of embodiments of this disclosure. Numeric ranges are inclusive of the numbers defining the range.

The headings provided herein are not limitations of the various aspects or embodiments of this disclosure which can be had by reference to the specification as a whole. Accordingly, the terms defined immediately below are more fully defined by reference to the specification as a whole.

Other definitions of terms may appear throughout the specification. Before the exemplary embodiments are described in more detail, it is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within this disclosure. The upper and lower limits of these smaller ranges may independently be included or excluded in the range, and each range where either, neither or both limits are included in the smaller ranges is also encompassed within this disclosure, subject to any specifically excluded limit in the stated range. Where the stated range includes one or both of the limits, ranges excluding either or both of those included limits are also included in this disclosure.

The following definitions and abbreviations are to be use for the interpretation of the claims and the specification.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The abbreviation "ATCC" refers to the American Type Culture Collection International Depository, Manassas, VA, USA. "ATCC No." refers to the accession number of cultures on deposit with ATCC.

The abbreviation "DSM" refers to the accession number of cultures deposited with the German Collection of Microorganisms and Cell Cultures (DSMZ).

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present). Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "deletion" or "disruption" when used in reference to a gene, genetic construct or the like with refer to the partial or complete inactivation of nucleic acid sequence as it normally functions. A deletion in a sequence means the removal of all or part of the sequence which may results in the complete or partial inactivation of the sequence. A disruption or insertion in the sequence will refer to the addition of an element within the sequence that will again decrease or eliminate the ability of the sequence to function normally. Deletions or disruptions will render the gene or coding sequence "non-functional" within the meaning of the present invention.

"Gene" refers to a nucleic acid fragment that expresses a specific protein, and may refer to the coding region alone or may include regulatory sequences preceding (5' non-coding sequences) and following (3' non-coding sequences) the coding sequence.

"Intergenic region" means a stretch of DNA sequences located between genes. Intergenic regions are a subset of noncoding DNA.

"Genome" means a collection of polynucleotide sequences containing the entirety of the genetic information that defines the organisms. The Genomic sequences of an organism includes both the genes and the non-coding sequences of the DNA. Typically as used herein genome will refer to a prokaryotic genome which is contained on a single chromosome.

"Phenotype" means the detectable characteristics of a cell or organism. A "beneficial Phenotype" means a phenotype of an evolved cell that enhances its storage stability, effective productivity including enhancements in cell growth, tolerance to a stressor or a stress condition including but not limited to tolerance to heat, tolerance to osmotic pressure, tolerance to surface active agents and tolerance to oxidative stress.

"Polynucleotide", "nucleic acid sequence", "nucleotide sequence", or "nucleic acid fragment" are used interchangeably and refer to a polymer of ribonucleic acid (RNA) or deoxyribonucleic acid (DNA) that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, polyadenylation recognition sequences, RNA processing sites, effector binding sites and stem-loop structures.

The term "bacterium" or "bacterial" or "prokaryotic" will be used herein to refer to any bacterial species, strains or combinations thereof, and is not limited to strains currently accepted as probiotics. However, bacterial strains used in the present invention are those that are suitable for human and/or animal consumption. A skilled person will be readily aware of specific species and or strains from within the genera described herein which are used in the food and/or agricultural industries and which are generally considered suitable for human and/or animal consumption. Such bacterial strains are typically non-pathogenic, and may be generally regarded as safe for human use (e.g. GRAS). The term "bacterium" is generally used to refer to whole bacteria, for example whole viable bacteria. Bacteria suitable for use in the present invention include, but are not limited to, *Bifidobacterium, Lactobacillus, Brevibacterium, Propionibacterium, Lactococcus, Streptococcus.*

As used herein, the term "mutant" refers to any microorganism resulting from modification of the parent (i.e. deposited) strain. For example, a mutant may be a microorganism resulting from genetically modifying a deposited strain.

The term "mutation" means a change in the nucleotide sequence of an organism that can include a substitution of one or more nucleotides with one or more different nucleotides, or a deletion or insertion of one or more nucleotides. Within the context of the invention mutations may occur naturally or as the result of the presence of a stress condition.

The term "*Bifidobacterium*" refers to bacteria that are gram-positive and non-acid fast. They are pleomorphic, cornyform rods and usually appear clubbed or branching. They are generally non-motile and non-spore forming. Species of *Bifidobacterium* include *B. actinocoloniiforme B. adolescentis B. angulatum B. animalis B. aquikefiri B. asteroids B. biavatii B. bifidum B. bohemicum B. bombi B. bourn B. breve B. callitrichos B. catenulatum B. choerinum B. commune B. coryneforme B. cuniculi B. crudilactis B. denticolens B. dentium B. eulemuris B. faecale B. gallicum B. gallinarum B. hapali B. indicum B. inopinatum B. kashiwanohense B. infantis B. lemurum B. longum B. magnum B. metycicum B. minimum B. mongoliense B. moukalabense B. myosotis B. pseudocatenulatum B. pseudolongum B. psychraerophilum B. pullorum B. reuteri B. ruminantium B. saguini B. scardovii B. stellenboschense B. stercoris B. saeculare B. subtile B. thermacidophilum B. thermophilum B. tissieri* and *B. tsurumiense.* A preferred subspecies in the present invention is *B. animalis* subps. *lactis.* A preferred *Bifidobacterium* strain in the present invention is *B. animalis* subsp. *lactis* Bi-07. As used herein "*Bifidobacterium* Bi-07, ATCC PTA SD5220" refers to the ancestral *Bifidobacterium* strain from which the BBi strains of the invention were evolved.

The term "*Lactobacillus*" refers a genus of bacteria that is a Gram-positive, facultative anaerobe that is rod-shaped, and non-spore forming, with a DNA base composition of less than 53% G+C. They generally are non-respiratory and lack catalase. They ferment glucose primarily to lactic acid, or to lactic acid, $CO_2$ and ethanol. Generally, *Lactobacillus* grows anaerobically, but unlike most anaerobes, they grow in the presence of $O_2$ as "aerotolerant anaerobes". Although they lack catalase, they possess superoxide dismutase and have alternative means to detoxify peroxide radicals, generally through peroxidase enzymes. Species of *Lactobacillus* include *L. acetotolerans, L. acidifarinae L. acidipiscis L. acidophilus, L. agilis, L. algidus, L. alimentarius L. amylolyticus L. amylophilus L. amylotrophicus L. amylovorus, L. animalis, L. antri, L. apodeme L. aviaries L. bifermentans L. brevis L. buchneri L. cameffiae, L. casei L. catenaformis L. ceti L. coleohominis L. collinoides L. composti L. concavus L. coryniformis L. crispatus L. crustorum*

*L. curvatus L. delbrueckii L. delbrueckii* subsp. *bulgaricus L. delbrueckii* subsp. *delbrueckii L. delbrueckii* subsp. *lactis L. dextrinicus L. diolivorans L. equi L. equigenerosi L. farraginis L. farciminis L. fermentum L. fornicalis L. fructivorans L. frumenti L. fuchuensis L. gallinarum L. gasseri L. gastricus L. ghanensis L. graminis L. hammesii L. hamster L. harbinensis L. hayakitensis L. helveticus L. hilgardii L. homohiochii L. iners L. ingluviei L. intestinalis L. jensenii L. johnsonii L. kalixensis L. kefiranofaciens L. kefiri L. kimchii L. kitasatonis L. kunkeei L. leichmannii L. lindneri L. malefermentans L. mali L. manihotivorans L. mindensis L. mucosae L. murinus L. nagelii L. namurensis L. nantensis L. oligofermentans L. oris L. panis L. pantheris L. parabrevis L. parabuchneri L. paracasei L. paracoffinoides L. parafarraginis L. parakefiri L. paralimentarius L. paraplantarum L. pentosus L. perolens L. plantarum L. pontis L. protectus L. psittaci L. rennini L. reuteri L. rhamnosus L. rimae L. rogosae L. rossiae L. ruminis L. saerimneri L. sakei L. salivarius L. sanfranciscensis L. satsumensis L. secaliphilus L. sharpeae L. siliginis L. spicheri L. suebicus L. thailandensis L. ultunensis L. vaccinostercus L. vaginalis L. versmoldensis L. vini L. vitulinus L. zeae* and *L. zymae.* As used herein "*Lactobacillus acidophilus* NCFM ATCC 700396" refers to the ancestral strain of *Lactobacillus acidophilus* NCFM from which the *L. acidophilus* strains of the invention were evolved.

The term "Adaptation" describes a process by which an organism becomes better suited for an environment through the inheritance of beneficial traits. Adaptation is a multigenerational process during which beneficial mutations arise in a population and can increase in frequency over time due to the benefit they confer. In sexually reproducing organisms, beneficial traits in different parents can be recombined through sexual recombination and passed on together to the offspring.

The term "Selection" describes a process that results in a change in allele frequencies in a population over time as a result of competition. Beneficial alleles increase the competitive fitness and lead to increased reproduction and survival of individuals with these alleles, resulting in increased frequency of these beneficial alleles in the population over time.

The term "genetic variation" describes the total set of genetic mutations in all the genes in an assembly of different individuals or in a population. A clonal population has no genetic variation. Genetic variation in a population can increase through processes like mutations, recombination, hybridization, horizontal gene transfer, copy number variation to name a few. Genetic variation can decrease through selection or genetic drift, which is due to random sampling error.

The term "Experimental evolution" describes a method that replicates the process of natural selection in the laboratory. Most experiments performed rely on a combination of the creation of genetic variation through natural mutation rates and selection through competition, resulting in better adapted individuals with increased fitness in the selective environment than the ancestor. The process of natural selection is replicated by working with large population sizes and over many generations (100+). Experimental evolution can also include experiments in which the fitness of the evolved populations decreases, which is often the case in mutation accumulation experiments, where populations are bottlenecked (reduced to a single cell or sibling mate pair) to reduce competition resulting in the accumulation of a random set of mutations (not such beneficial mutations). Experimental evolution experiments can be conducted in different selection regimes, such as but not limited to batch cultures (flask transfers), continuous culture vessels (e.g. chemostats, turbidostats, morbidostats), agar plates or microfluidic droplets.

The term "Ancestor" or "ancestral strain" describes an individual from which individuals with similar, but different genotypes are derived. This can be the common ancestor of two phylogenetically related species or the starting clone of an experimental evolution experiment. Here the term "Ancestor" is used to refer to the initial clones used to seed the replicated populations of the evolution experiments. In this case the "Ancestors" are clones currently sold as probiotics as part of the HOWARU® brand.

The term "Evolutionary time" refers to a time frame during which an evolutionary process such as adaptation takes place, which requires hundreds to thousands of generations. It is different from ecological time which is much shorter as ecological processes happen much faster than evolutionary processes.

The term "Natural mutation" refers to mutations that occur due to errors during replication, DNA damage or DNA repair. It relies on the natural mutation rate, which describes how often a nucleotide is changed in the genome per generation and genome or how many deletions or insertions occur in the genome per generation and genome. The natural mutation rate is an adaptive trait and differs among organisms and environments.

The term "stressor" means any environmental stress to which a bacterial strain may be exposed to and which will, over time, produce genetic changes in the bacteria. Stressors of particular interest in the present invention are those that are associated with the manufacturing protocols for probiotics and included but are not limited to salt or osmotic stressors, heat stressors, oxidative stressors and acid stressors. Strains that have been exposed to heat stress will be referred to herein as "heat evolved". Strains that have been exposed to osmotic stress will be referred to herein as "salt evolved".

The term "storage stability" characterizes the ability of a collection of cells to maintain their viability during storage. A cell in this context is considered viable if it can grow and multiply again if transferred into permissive conditions. Assay methods to assess storage stability comprise, but are not limited, to most probable number (MPN) analyses or the plating and counting of colony forming units (CFU). Due to the complexity of cells, the loss of viability of a collection of cells can be described as a stochastic process at the level of single cells. However, for a collection of cells, the collection's expected decay rate or fraction of viable cells can be characterized (e.g. by determining the MPN or CFU concentration at start and end of a storage experiment) and is often used equivalently to the term storage stability. In case the collection of cells consists predominantly of monoclonal cells, the determined rate of decay in MPN or CFU numbers or decrease in fraction of viable cells is interchangeable with the storage stability of a strain.

Storage stability of cells can be tested at different conditions with or without formulations and with or without specific packaging. Important determinants of the conditions are, but are not limited to, the temperature, relative humidity, chemical composition (e.g. oxygen-content in a gas atmosphere) and radiation levels of the environment. In addition, storage stability depends on the nature of the cells (e.g. type of strains used), the way the cells are produced, as well as the downstream unit operations in which the cells are processed.

Conditions for testing storage stability of beneficial microbes, even if their use as an active pharmaceutical ingredient is not intended, usually follow the guidance as laid out in the document "Stability testing of active pharmaceutical ingredients and finished pharmaceutical products" as published as Annex 2 in the World Health Organization (WHO) Technical Report Series, No. 953, 2009 (1), as well as the ICH guideline "Q1A(R2): Stability Testing of New Drug Substances and Products" released by the International Council for Harmonization of Technical Requirements for Pharmaceuticals for Human Use (ICH) in 2003. Both documents are herewith included by reference.

In order to standardize testing for storage stability, the International Council for Harmonisation of Technical Requirements for Pharmaceuticals for Human Use (ICH) divided the world into five different zones:

| | |
|---|---|
| Zone I | Temperate zone |
| Zone II | Mediterranean/subtropical zone |
| Zone III | Hot dry zone |
| Zone IVa | Hot humid/tropical zone |
| Zoen IVb | Hot/higher humidity |

The climate conditions for these zones in long-term storage stability testing are usually reflected as

| | | |
|---|---|---|
| Zone I | 21° C. ± 2° C. | 45% RH ± 5% RH |
| Zone II | 25° C. ± 2° C. | 60% RH ± 5% RH |
| Zone III | 30° C. ± 2° C. | 35% RH ± 5% RH |
| Zone IVa | 30° C. ± 2° C. | 65% RH ± 5% RH |
| Zone IVb | 30° C. ± 2° C. | 75% RH ± 5% RH |

Frequently also higher temperatures than 30° C.±2° C. as described in above mentioned ICH long-term testing recommendations are used for assessing storage stability, comprising but not limited to e.g. 38° C.±2° C., 40° C.±2° C., or 50° C.±2° C., in order to "accelerate" decay processes and allow for faster testing of storage stability within shorter time frame.

The term "critical process parameters" or "CPP" are key variables affecting the manufacturing process of live cell products that are set and/or controlled. Major CPPs in the fermentation process comprise, but are not limited to (i) pH, (ii) temperature, (iii) stirrer speed, (iv) gas input, (v) elapsed process time, (vi) inoculum ratio, (vii) media composition, (viii) media preparation, and (ix) composition of gas input.

The term "effective productivity" defines a productivity metric. It relates the classical concept of "productivity", characterizing the number of cells produced per volume and time in a production process, with the stability of the produced cells as a formulated product on the shelf at specified conditions. The total time ($t_{total}$) for assessing effective productivity of a process comprises (i) the time for preparing the fermenter ($t_{prep}$), (ii) the time from inoculum of the fermenter to harvest of the fermenter ($t_{grow}$), and (iii) the time required for downstream processing and formulating the cells into the finished product ($t_{form}$), and can be determined according to:

$$t_{total} = t_{prep} + t_{grow} + t_{from}$$

The total cell product ($\Delta cp_{total}$) is the number of cells that are viable at the end of storage time resulting from a given volume in the last-stage fermenter, corrected for the fraction of cell product that was used to initiate the process (seed vials and/or inoculum). From these key metrics, "effective productivity" ($p_{effective}$) for a given manufacturing process and specific to the applied storage conditions can be derived according to:

$$p_{effective} = \frac{\Delta c p_{total}}{t_{total}} = \frac{\Delta c p_{total}}{(t_{prep} + t_{grow} + t_{form})}$$

Typically, effective productivity refers only to the last stage fermenter. Also, frequently the downstream and formulation unit operations of a process are kept the same and/or exhibit fairly similar time requirements, and can therefore be left out. Last but not least, the amount of inoculum introduced in the process is usually negligible when compared to the final cell concentration in the fermenter at harvest, and therefore can be ignored in a first approximation, simplifying the formula to:

$$p_{effective} \approx \frac{c p_{total}}{t_{grow (last\ stage\ fermenter)}}$$

with the total cell product ($cp_{total}$) representing the number of cells that are viable at the end of storage time resulting from a given volume in the last-stage fermenter without any correction for the fraction of cell product that was used to initiate the process (seed vials and/or inoculum). In the context of the described work, methods and tools to optimize "effective productivity" are introduced, e.g. allowing for the selection of improved strains or the optimization of critical process parameters.

As used herein, the term "probiotic" refers to a live microorganism which, when administered in adequate amounts, confers a health benefit on the recipient. They are suitable for human consumption, are non-pathogenic and non-toxic. These probiotic strains generally have the ability to survive the passage through the upper part of the digestive tract. Probiotic bacteria typically exercise their beneficial effect on health on the one hand via ecological interactions with the resident flora in the digestive tract, and on the other hand via their ability to influence the immune system in a positive manner via the "GALT" (gut-associated lymphoid tissue). Probiotic bacteria, when given in a sufficient number, have the ability to progress live through the intestine. However, they do not cross the intestinal barrier and their primary effects are therefore induced in the lumen and/or the wall of the gastrointestinal tract. They then form part of the resident microbiota during the administration period. This colonization (or transient colonization) allows the probiotic bacteria to exercise a beneficial effect, such as the repression of potentially pathogenic micro-organisms present in the flora and interactions with the immune system of the intestine.

The invention relates to novel evolved strains of *Bifidobacterium* and *Lactobacillus* having a unique genetic profile and have demonstrated enhanced increased storage stability or effective productivity. Storage stability has been measured by a unique series of assays that has allowed the applicants to select evolved strains that have a surprising increase in storage stability and effective productivity. The invention additionally provides methods for the experimental evolution of probiotic strains to develop underlying genetic modifications that are specifically linked to increased storage stability.

Probiotic Strains:
Bifidobacterium:

The invention provides evolved strains of *Bifidobacterium* having improved storage stability. Bifidobacteria comprise the predominant intestinal microbiota in infants and they are abundant also in the adult population comprising up to 10% of the normal intestinal microbiota, although their numbers start to decline in the elderly. An individual is typically colonized with 1-4 bifidobacterial species (Mättö et al., 2004). In addition to the individual variation, composition of bifidobacterial species varies between different age groups. *B. longum* biovar *infantis*, *B. breve* and *B. bifidum* are the most prevalent species in infants and *B. longum* biovar *longum*, *B. adolescentis*, *B. bifidum* and *B. catenulatum* in adults. Variation in the number of bifidobacteria (Mueller et al., 2006,) and composition of species (Matto et al., 2004) between geographic regions has also been reported. Bifidobacteria are generally considered as health promoting bacteria and an increase in bifidobacterial numbers in the intestine is typically used as an end-point in intervention studies with intestinal health-targeted products such as probiotics and prebiotics.

*Bifidobacterium* spp. strains are used as probiotics. However, due to technological challenges related to stability of the genus, fairly few distinct species and strains, mainly *B. animalis* subps. *lactis*, are available on the current market. Bifidobacteria or bifidobacteria-containing strain mixtures have shown promising results e.g. in alleviation of the symptoms of irritable bowel syndrome (Brenner and Chey, 2009), inflammatory bowel disease (Macfarlane et al., 2009), diarrhea (Chouraqui et al., 2004), eczema (Kim et al., 2010), asthma prevention (Yoo et al., 2007) and common cold (de Vrese et al., 2005).

Accordingly, *Bifidobacterium* ssp are prime targets for probiotic applications and strains having increased storage stability will be of particular interest. Any species of *Bifidobacterium* is applicable in the present invention and may be subjected to the experimental evolution protocols described herein where the species *Bifidobacterium animalis*, *Bifidobacterium breve*, *Bifidobacterium infantis*, *Bifidobacterium lactis*, *Bifidobacterium longum*, *Bifidobacterium bifidum* and *Bifidobacterium adolescentis* are preferred and where strains of *Bifidobacterium animalis lactis*, and in particular strain Bi-07 is most preferred. Bi-07 is commercially available from DuPont, and has been deposited at the ATCC under the deposit number PTA-SD5220. It is fully sequenced and the sequence if available under the accession number NC 017867.

Lactobacillus

In addition to evolved strains of *Bifidobacterium* the invention provides strains of *Lactobacillus* that demonstrate increased storage stability. Any species of *Lactobacillus* may be used in the invention and subjected to experimental evolution protocols described herein, where the species *L. acidophilus*, *L. curvatus*, *L. rhamnosus*, *L. casei*, *L. paracasei*, *L. salivarius*, *L. reuteri*, *L. salivarius*, *L. gaffinarum*, *L. crispatus*, *L. agilis* are preferred and the species *Lactobacillus paracasei* and *Lactobacillus acidophilus* NCFM is most preferred. *Lactobacillus paracasei* is a Gram-positive, non-spore formingrod that is a common inhabitant of the human intestinal tract. *L. paracasei* strains are also found naturally in fermented vegetables, milk and meat. Strains of this species are used in many food products, including traditional fermented milks and cheese. Selected strains of this species are also used in probiotic foods and dietary supplements. *Lactobacillus paracasei* Lpc-37 is commercially available from DuPont. It has been genetically characterized and properly classified as *Lactobacillus paracasei* by 16S rRNA gene sequencing. *L. paracasei* Lpc-37 is a strain isolated from a dairy source and has been deposited in the American Type Culture Collection as SD5275. Its genome has been fully sequenced and is available on NCBI under the accession number NOKL00000000. *Lactobacillus acidophilus* is a species of Gram-positive bacteria in the genus *Lactobacillus*. *L. acidophilus* is a homofermentative, microaerophilic species, fermenting sugars into lactic acid, and grows readily at rather low pH values (below pH 5.0) and has an optimum growth temperature of around 37° C. (99° F.). *L. acidophilus* occurs naturally in the human and animal gastrointestinal tract and mouth and has been shown to have probiotic efficacy. Its genome has been sequenced. *Lactobacillus acidophilus* NCFM® was isolated from a human fecal sample in the early 1970s. The strain designation NCFM® is derived from "North Carolina Food Microbiology," the research laboratory at North Carolina State University (NCSU) where isolation took place. The strain has been shown to have beneficial effects on humans when ingested orally and has been sold commercially for more than 25 years. The strain is available from ATCC as 700396. The genome has been completely sequenced and is available from NCBI under the accession number NC 006814.

Experimental Evolution Protocols

The methods of the invention utilize experimental evolution protocols to evolve various probiotic strains to attain enhanced or improved storage stability. The present protocols involve subjecting ancestral strains to a variety of stresses in an iterative fashion to create genetic changes in the strains that manifest phenotypically both in the form of increased tolerance to the stress and in increased storage stability of the strain. A variety of stressors may be employed in the experimental evolution protocols including heat, salt, surfactants, and acids or bases. A typical experimental evolution protocol begins by selecting a specific ancestral strain having well documented probiotic properties. Each strain is grown up in a suitable culture media, plated on agar plates and single colonies are isolated, grown up and frozen to create a bank of frozen stock. These single colonies from the stock are then used to found replicated populations that are cultured and subjected to various concentrations of a stressor for multiple generations, where at least 25, 30, 35, 40, 45, 50, 55, 60, 65, 70, 75, 80, 85, 90, 95, 100 generations will be expected to produce evolved strains. Those of skill in the art will appreciate that culturing in excess of 100 or 300 or 400 or 500 generations may be required to evolve strains depending on the stressor used and the underlying genetic characteristics of the strain. During the selection experiment, the concentration of the stressors can be gradually increased. In some circumstances the rate of mutation can be increased by the exposure to alternate mutagenic agents in combination with the stressor. Such mutagenic agents are common and well known in the art and include but are not limited to UV exposure, chemical mutagenesis (e.g. ethyl methanesulfonate, nitrous acid, ethidium bromide, mitomycin C (not limited to)), and transposon mediated mutagenesis.

Where heat is used as a stressor the exposure temperature should be above the normal growth temperature of the wildtype or ancestral strain and preferably, 1° C. to 20° C. above the normal growth temperature. The optimal temperatures for selecting evolved strains will vary with the bacteria chosen and the progress of the selection experiment. For example, where the strain is a species of *Bifidobacterium* the selection temperature may be about 41° C. to about 50° C.

Similarly, where osmotic stress is introduced by exposure to salt the concentrations of the salt will vary depending on the compound used and the growth characteristics of the bacteria. A variety of salts may be used as stressors in the invention including but not limited to NaCl, KCl, $CaCl_2$. When using NaCl or KCl for example concentrations may range from at least about 0.2% to about 1.2% in the growth medium, or at least about 0.4% to at least about 1.0%, or at least about 0.5% or at least about 0.5% to at least about 0.8% in the growth medium where at least about 0.4% to at least about 0.8% is preferred.

Surface active agents such as surfactants may be used to introduce cell envelop stress into the bacterial population. Surface active agents are well known and commonly used and include but are not limited to anionic surfactants, such as for example, Sodium dodecyl sulfate (SDS), sodium lauryl sulfate (SLS), ammonium lauryl sulfate (ALS), or their ethoxylated companions, sodium laureth sulfate (SLES); or cationic surfactants such as for example amines, alkylimidazolines, alkoxylated amines, and quaternized ammonium compounds; or amphoteric surfactants or non-ionic surfactants. Preferred for use in the present invention is SDS, where typical concentration of surfactant will be close to the sublethal concentrations and range from about 0.008% to about 0.01% in the growth medium.

Cells undergoing experimental evolution will be grown up in liquid media and diluted to a specific OD into fresh culture broth supplemented with the stressor if appropriate or exposed to higher temperature. Generally, the clonal populations are transferred every 24-48 hours after the average OD of the population is determined. The number of generations per day is calculated on the basis of the following formula:

$$\text{Number of generations} = \frac{\log\left(\frac{\text{Final } OD}{\text{Initial } OD}\right)}{\log 2}$$

The number of generations is monitored. When an increase in populations density is seen as compared with the ancestral strain then selection pressure is increased. Where the number of generations is seen to decrease and the populations cannot make up the dilution at transfer, the selection pressure may be decreased in order to maintain a viable population. In this fashion, the selection pressure is maintained at the highest possible concentration of stressor over the life of the evolution process. At the end of the evolution process populations may be frozen for further study.

Assays to Identify Improved Strains

A number of assays are employed in the present invention to determine the relative storage stability or effective productivity of the evolved strains.

Spot Plating Assay

The spot plating assay was used as the first screen to identify those stress evolved clones on the basis of improved storage stability. To identify improved strains, single colonies were isolated from the evolved populations and tested for improved survival during storage in stressful conditions which span a range of temperatures (typically from 4 C to 50 C) and a range to different levels of humidity (0-65%) in a spot plating assay (see General Methods for a detailed description of the spot plating assay). The isolated clones were grown up as single clones, and a standard amount of cells are mixed with a stabilizer buffer. The stabilized cells were flash frozen and freeze dried before being exposed to the storage conditions. At regular intervals, the stored cell pellets were rehydrated with the same culture media used for the selections but without any stressor added, serially diluted in 10-fold dilutions and plated onto agar plates. Viability could also be assessed using most probable number assays (MPN). The highest dilution at which a stored sample was still able to grow was recorded. The most viable clones were selected from the spot plating assay and subjected to the accelerated assay to gain more accurate measurements of the clone's ability to survive different long-term storage conditions. Clones that were tested in the accelerated assays were sequenced using whole genome sequencing to identify mutations that occurred during the selection experiment.

Accelerated Assay

Clones identified in the spot plating assay above were subjected a sequential series of assays to evaluate storage stability and effective productivity. Briefly, evolved clones and there corresponding ancestral strains (as controls) were grown in a bio-reactor under controlled conditions of pH, temperature and stirrer speed. Following bio-reactor cultivation the clones were subjected to small-scale plate assays to determine storage stability and effective productivity under various storage conditions, including storage of "wet" conditions at 25° C. or 30° C., 40° C. and at a relative humidity that may range from about 35% to about 40% to about 60% to about 70% or to about 75% or in the alternative under "dry" conditions where cells are stored at about 50° C. and a relative humidity of less than about 1%. Based on determination of dry cell weight and CFU, storage stability and effective productivity of the evolved clones opposite the ancestral strains were determined.

PREFERRED EMBODIMENTS

Evolved Strains of *Bifidobacterium animalis* Supspecies *lactis* Bi-07 (BBi)

BBi strains were evolved in the presence of a number of stressors including elevated temperature, salt (KCl, NaCl), surface active agents, (SDS), and oxidizing agents (peroxide). Whereas exposure to peroxide and SDS gave inconclusive results, clones evolved against osmotic and heat stress demonstrated clear improvement in storage stability and effective productivity as compared with the ancestral strain.

Heat-Evolved Clones

At least three heat-evolved populations had clones with improved storage stability. Two clones were chosen from two different populations, (BBi Heat 4.1 and BBi Heat 6.6), and their storage stability tested under wet and dry conditions in the accelerated assays. The CFUs at the end of fermentation (end of run, EOR) of the evolved strains did not differ from the unevolved controls but it took the evolved clones about 2 hours longer to reach the end of fermentation than the unevolved control. One of the clones, Heat 4.1, showed >100% improved survival in wet conditions and 68% improvement in dry conditions. The other clone, Heat 6.6, also showed improvements. Taking overall survival into account (including survival during downstream processing and storage), both Heat 4.1 and Heat 6.6 performed significantly better in wet conditions for 14 days. After 137 days in dry conditions at 30° C., the number of colony-forming cells of the evolved strains is 5-50× better than the ancestral strain. In dry conditions, only Heat 4.1 shows improved overall survival after 14 days.

Salt-Evolved Clones

Seven clones from six NaCl-evolved and six KCl-evolved populations were tested for improved storage stability using the spot plating assay. Overall, all six KCl evolved populations had at least one clone with increased storage stability, while five NaCl-evolved populations had more stable clones (see examples). Of these more stable clones, two KCl-evolved, KCl 1.2 and KCl 5.5, and four NaCl-evolved strains, NaCl 2.7, NaCl 3.3, NaCl 5.1 and NaCl 6.2 were tested in the accelerated assays. All clones had higher CFU counts at the end of fermentation relative to the unevolved controls. Taking all the fermentations into account, none of the salt evolved clones improved in storage stability over 14 days at dry conditions, however under wet storage conditions, an overall improvement in survival was observed after 14 days in all but one salt evolved clone.

Physiological Differences of the Evolved Clones at the End of Fermentation

The evolved clones were analyzed for changes in energy charge as well as for organic acid and fatty acid composition opposite the ancestral strains. The energy charge of the cells differed considerably at the end of fermentation. Interestingly, both storage stable heat evolved clones had higher energy charges than the control or the salt-evolved clones. Similarly, the heat-evolved clones stand out with a slightly different metabolic profile by producing less lactate, acetate and ethanol, and more pyruvate and formate than the unevolved ancestral control. While the salt-evolved clones also produced more pyruvate, they made less formate and ethanol than the control. The fatty acid composition also showed considerable variation among the strains. Most notably, the heat-evolved clone BBi Heat 4.1 differed both from other evolved clone and the control with very little 16:0 fatty acids and a large proportion of unknowns. BBi Heat 6.6 was very similar to the control, while all other evolved clones has less 18:1 and more unknown fatty acids.

Genetic Changes

All clones tested in the accelerated assays were submitted for whole genome sequencing. Because the clones had independent evolutionary histories, mutations that evolved in multiple strains were of particular interest, especially when different independently evolved strains acquired different mutations in the same gene.

Mutations in the Heat-Evolved Populations

The heat-evolved clones with improved storage stability, Heat 4.1 and Heat 6.6, acquired 12 and 13 mutations, respectively (see examples). Seven of these mutations occurred in both independently evolved strains, while two of the mutations occurred in the same gene, but at different locations in the gene in the two evolved strains. The polyribonucleotide nucleotidyltransferase (EC 2.7.7.8), PNPase, and the response regulators consisting of a CheY-like receiver domain and a winged-helix DNA-binding domain are of particular interest, because we found mutations in both strains, but at different locations, suggesting convergent evolution.

Mutations in the Salt-Evolved Clones

We sequenced two clones KCl-evolved and four NaCl-evolved clones With the exception of one non-synonymous SNP in a putative glucose uptake permease and two mutations in intergenic regions, all mutations were synonymous SNPs. Three of those synonymous mutations also occurred in the two heat-evolved clones (mutations in arginine/ornithine antiporter ArcD, Pyridoxine biosynthesis glutamine aminotransferase glutaminase subunit, and SSU ribosomal protein S5p(S2e)), but were not found when sequencing the ancestral strain. The two KCl-evolved clones shared five more mutations: a SNP in an intergenic region between two hypothetical genes, a synonymous SNP in a Phosphoglucomutase, a non-synonymous SNP to a stop codon in a hydrolase, and non-synonymous SNPs in a hypothetical gene and in the response regulators consisting of a CheY-like receiver domain and a winged-helix DNA-binding. The latter SNP was the same R175L mutation in both strains, and was not found in the same gene in heat-evolved clones. The NaCl-evolved clones did not acquire any mutations in this gene. Among the four NaCl-evolved clones, we observed 16 mutations that occurred in all four clones. Five of them were synonymous SNPs, and one mutations was in an intergenic region between a putative amidotransferase and a hypothetical gene. None of the salt-evolved clones showed consistent improvement in storage stability. KCl 1.2, NaCl 2.7, and NaCl 6.2 showed some improvements in storage stability. Four mutations were unique to NaCl 2.7 and NaCl 6.2. One of them was a synonymous change in large transmembrane protein possibly involved in transport, another mutation was in an intergenic region between a uridylyltransferase and a transcriptional regulator of the ArsR family. A deletion in a hypothetical gene likely caused a frameshift. A V58M mutation evolved in TrkA, a potassium uptake protein in both improved, NaCl-evolved clones independently.

Evolved Strains of Lactobacillus paracasei (LCP37)

LCP37 strains were evolved in the presence of a number of stressors including elevated temperature, ox gall, salt (KCl, NaCl), surface active agents, (SDS), and oxidizing agents (peroxide). Two strains, a heat-evolved and a SDS-evolved clone, performed well after the spot plating assays and were moved forward into the accelerated assays.

Heat Evolved Clones

Results from the accelerated assays indicated that the heat-evolved stains from fermentation runs at pH 5.2 demonstrated increased storage stability under dry conditions (50° C. and no humidity), where the CFU and cell dry weight of this strain were comparable to the ancestral control.

Sequencing of the heat-evolved clone revealed 16 mutations, nine of them were non-synonymous mutation, four synonymous and three intergenic (Table A). A comparison was made of the protein abundance of the genes in the wildtype and heat-evolved clone. Of the 13 genes with mutations, proteomic data was generated for four genes: lagC_2, rpoB, htrA and ICMKMEMM_01590, an aspartate aminotransferase. Only one of them, HtrA was less abundant in the evolved clone, compared to the wildtype control both at pH=5.2 and pH=6.4.

TABLE A genetic mutations found in LCP37 heat evolved strains

| Description | Position | Contig | Change | Annotation |
| --- | --- | --- | --- | --- |
| scyllo-inositol 2-dehydrogenase (NAD(+)) | 242,968 | A | A→G | Q330Q (CAA→CAG) |

TABLE A-continued genetic mutations found in LCP37 heat evolved strains

| Description | Position | Contig | Change | Annotation |
|---|---|---|---|---|
| Dipeptide-binding protein DppE | 324,159 | A | G→T | G151V (GGC→GTC) |
| hypothetical protein/HTH-type transcriptional regulator DegA | 336,410 | A | A→G | intergenic (+332/−49) |
| Mannitol-1-phosphate 5-dehydrogenase/putative HTH-type transcriptional regulator YybR | 458,056 | A | G→C | intergenic (+240/+98) |
| Cobalt-dependent inorganic pyrophosphatase | 877,156 | A | C→T | R60W (CGG→TGG) |
| Cobalt-dependent inorganic pyrophosphatase | 877,419 | A | C→T | S147S (AGC→AGT) |
| putative glucose uptake protein GlcU | 1,222,089 | A | G→A | G275S (GGT→AGT) |
| hypothetical protein | 29,191 | B | C→G | L206L (CTG→CTC) |
| tRNA-specific 2-thiouridylase MnmA | 161,498 | B | G→A | A13T (GCA→ACA) |
| Tagatose-6-phosphate kinase | 219,790 | B | C→T | A279T (GCG→ACG) |
| Aspartate aminotransferase | 376,122 | B | C→T | S145S (TCG→TCA) |
| Bacitracin export permease protein BceB | 644,261 | B | G→A | A373V (GCC→GTC) |
| Cytochrome bd ubiquinol oxidase subunit 1 | 1,123,464 | B | C→T | R209H (CGT→CAT) |
| Alternate 30S ribosomal protein S14/Manganese-binding lipoprotein MntA | 1,325,894 | B | C→A | intergenic (−237/−172) |
| DNA-directed RNA polymerase subunit beta | 1,407,338 | B | C→A | M952I (ATG→ATT) |
| Serine protease Do-like HtrA | 1,737,666 | B | T→A | D387V (GAT→GTT) |

Although LPC37 was selected for increased tolerance to heat for a very short time, it was possible to identify a single clone with improved storage stability of almost 50% in dry conditions. The strain acquired only a few mutations, one of them in the tagatose-6-phosphatase (lacC_2). Tagatose has previously been shown to improve cells survival during freezing. Therefore the mutation in the heat-evolved strain could increase the amount of tagatose in the cell, resulting in more stable strains.

Evolved Strains of *Lactobacillus acidophilus* NCFM (NCFM)

Strains of NCFM were evolved against the stressors of heat, NaCl and KCl and preferred clones were selected on the basis of the spot plating assay as described above and then tested in the accelerated assays for improved stability. The heat-evolved clones were similar to the controls for both CFUs and cell dry weight. Storage stability of the evolved clones was improved in both wet (30° C. and 40% humidity) and dry (50° C. and no humidity) conditions for both heat-evolved clones, NCFM Heat 1.1 and NCFM Heat 6.3, and one KCl-evolved clone, NCFM KCl 2.4. Two NaCl evolved clones, NCFM NaCl 1.2 and NCFM NaCl 3.2, had higher storage stability in dry conditions.

The levels of organic acids in the cells at the end of fermentation were measured to get an indication of the metabolic activity of these cells during the fermentation. In general, it was observed that there was no difference between the unevolved and evolved strains in the production of lactate, pyruvate, glycerol, formate, acetate, ethanol and succinate in the two replicated assays. Only acetate seemed to be slightly lower in the heat-evolved clones. This suggests that the evolved clones have comparable metabolic activities as the unevolved strains.

The fatty acid composition of bacteria is tightly liked to membrane fluidity and has been shown to affect survival during freeze drying (Louesdon et al. 2015). Overall, the evolved cells have a very similar composition of fatty acids as the unevolved NCFM controls.

To identify mutations that could be responsible for the observed improvements in storage stability, we sequenced every clone that was tested in the accelerated assays using whole genome sequencing and aligned the reads to the published reference sequence of *L. acidophilus* NCFM using breseq (Deatherage and Barrick 2014). The two heat-evolved clones, NCFM Heat 1.1 and NCFM Heat 6.3 shared seven mutations, while two mutations were unique to NCFM Heat 6.3 (Table 16 and 17, Example 31). Among the three KCl-evolved clones, we identify 18 different mutations (seven in NCFM KCl 1.6, 13 in NCFM KCl 2.4 and ten in NCFM KCl 3.3), some of which were shared in different strains (Table B). Similarly, we identified 16 unique mutations in the NaCl-evolved clones, (six in NCFM NaCl 1.2, ten in NCFM NaCl 3.2 and five in NCFM NaCl 6.4), again some of the mutations were shared between different strains (Table C).

TABLE B

Mutations in KCL evolved strains - NCFM

| KCl 1.6 | KCl 2.4 | KCl 3.3 | Position | Mutation | Annotation | Gene/Direction | Description |
|---|---|---|---|---|---|---|---|
| X | X |   | 121,570 | Δ1 bp | coding (1210/1242 nt) | LBA0127 ← | transposase |
|   | X | X | 488,659 | G→T | intergenic (+166/−33) | msmR →/→ msmE | msm operon repressor/ABC transporter sugar-binding protein |

TABLE B-continued

Mutations in KCL evolved strains - NCFM

| KCl 1.6 | KCl 2.4 | KCl 3.3 | Position | Mutation | Annotation | Gene/Direction | Description |
|---|---|---|---|---|---|---|---|
|  | X | X | 493,811 | G→A | G256R (GGA→AGA) | msmK → | ABC transporter nucleotide binding protein |
|  | X | X | 525,130 | +T | coding (121/246 nt) | LBA0535 ← | putative permease |
| X |  |  | 525,451 | Δ17 bp | coding (340-356/567 nt) | LBA0536 ← | hypothetical protein |
|  | X | X | 640,012 | C→T | Q479* (CAA→TAA) | pacL → | H+-K+-exchanging ATPase |
| X |  |  | 798,717 | (AAC)$_{3\to2}$ | coding (311-313/2784 nt) | ileS → | isoleucyl-tRNA synthetase |
| X |  |  | 949,292 | (T)$_{7\to6}$ | intergenic (-43/-77) | LBA0974 ←/→ LBA0975 | hemolysin III/putative family protein |
|  |  | X | 951,255 | C→T | A253V (GCT→GTT) | LBA0977 → | Na+-H+ antiporter |
|  | X |  | 951,690 | C→T | T398I (ACA→ATA) | LBA0977 → | Na+-H+ antiporter |
|  | X |  | 952,137 | C→A | A2E (GCA→GAA) | LBA0978 → | GTP binding protein |
|  | X | X | 1,063,374 | C→A | I38I (ATC→ATA) | LBA1083 → | putative membrane nuclease |
| X | X | X | 1,247,879 | (T)$_{6\to4}$ | intergenic (-93/+77) | LBA1268 ←/← tsf | uridine mono phosphate kinase/elongation factor Ts |
|  | X |  | 1,289,736 | G→T | R457R (CGA→AGA) | recG ← | ATP-dependent DNA helicase |
|  | X | X | 1,415,803 | G→A | A306A (GCC→GCT) | LBA1429 ← | putative transporter-membrane protein |
| X | X | X | 1,660,027 | G→C | N253K (AAC→AAG) | corA ← | CorA family cationic transporter |
|  | X | X | 1,819,467 | G→A | R172W (CGG→TGG) | LBA1798 ← | response regulator |
| X |  |  | 1,977,419 | A→G | D149G (GAT→GGT) | copA → | copper-transporting ATPase |

TABLE C

Mutations in NaCl Evolved strains - NCFM

| NaCl 1.2 | NaCl 3.2 | NaCl 6.4 | Position | Mutation | Annotation | Gene/Direction | Description |
|---|---|---|---|---|---|---|---|
| X | X | X | 121,570 | Δ1 bp | coding (1210/1242 nt) | LBA0127 ← | transposase |
|  | X |  | 370,130 | C→T | S551N (AGT→AAT) | LBA0397 ← | ABC transporter |
| X |  | X | 415,332 | C→A | noncoding (1554/1572 nt) | LBA2012 → | 16S ribosomal RNA |
|  | X |  | 525,424 | C→T | G128D (GGT→GAT) | LBA0536 ← | hypothetical protein |
| X | X |  | 525,664 | G→T | S48* (TCA→TAA) | LBA0536 ← | hypothetical protein |
|  | X |  | 849,400 | C→T | R41C (CGT→TGT) | LBA0867 → | hypothetical protein |
|  | X |  | 1,139,229 | G→A | intergenic (-112/+26) | dnaD ←/← asnC | initiation of chromosome replication protein/ asparaginyl-tRNA synthetase |

TABLE C-continued

Mutations in NaCl Evolved strains - NCFM

| NaCl 1.2 | NaCl 3.2 | NaCl 6.4 | Position | Mutation | Annotation | Gene/Direction | Description |
|---|---|---|---|---|---|---|---|
| X | X | X | 1,247,879 | (T)$_{6\to4}$ | intergenic (−93/+77) | LBA1268 ←/← tsf | uridine mono phosphate kinase/elongation factor Ts |
|  | X |  | 1,331,678 | Δ105 bp | coding (1034-1138/1578 nt) | LBA1358 ← | ABC transporter ATP binding and permease protein |
| X |  |  | 1,392,204 | A→G | intergenic (−130/+140) | oppA ←/← LBA1401 | oligopeptide ABC trasporter substrate binding protein/peroxidase (Npx) |
|  | X |  | 1,396,669 | C→T | E179K (GAA→AAA) | LBA1408 ← | hypothetical protein |
|  | X |  | 1,475,525 | G→T | S294S (TCC→TCA) | LBA1487 ← | transposase, is605-tnpb |
|  | X |  | 1,820,001 | C→A | W424L (TGG→TTG) | LBA1799 ← | histidine kinase |
|  |  | X | 1,820,203 | T→A | I357L (ATA→TTA) | LBA1799 ← | histidine kinase |
| X |  |  | 1,985,498 | C→T | A131T (GCC→ACC) | LBA1973 ← | 6-phosphogluconate dehydrogenase |

In summary, both heat-evolved clones have a A232D mutation in clpC, which encodes the ATPase subunit of the ClpC-ClpP protease. This subunit directs proteins that are phosphorylated on arginine residues to ClpP for degradation and is involved in stress responses. Proteomic analysis suggests that the mutation in the evolved strains seems to reduce the protein abundance of clpC, which could be indicative of a reduced stress response in the evolved strains. The stop codon (E14*) in gntR encoding a gntR family like transcriptional regulator evolved in both strains and lead to significant reduction of GntR. The gene gntR is part of the GntI operon. It represses the transcription of the other three genes in the operon. In the presence of gluconate, the GntR repression is reduced and the three other genes involved in gluconate uptake are expressed. In *E. coli*, the Entner-Doudoroff (ED) pathway is also upregulated (Izu et al. 1997, Tsunedomi et al. 2003). However, *L. acidophilus* NCFM seems to lack two enzymes of the ED pathway. Therefore, upregulation of the gnt operon due to a lack of repression by GntR could be important for oxidative stress reduction or the conversion of gluconate to ribose-5-phosphate. *L. acidophilus* NCFM has several genes annotated as gntR.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

The meaning of abbreviations used is as follows: "min" means minute(s), "h" means hour(s), "μL" means microliter(s), "mL" means milliliter(s), "L" means liter(s), "nm" means nanometer(s), "mm" means millimeter(s), "cm" means centimeter(s), "μm" means micrometer(s), "mM" means millimolar, "M" means molar, "mmol" means millimole(s), "μmole" means micromole(s), "g" means gram(s), "μg" means microgram(s), "mg" means milligram(s), "g" means the gravitation constant, "rpm" means revolutions per minute, General Methods Materials and methods suitable for the maintenance and growth of bacterial cultures are also well known in the art. Techniques suitable for use in the following Examples may be found in *Manual of Methods for General Bacteriology* by Gerhardt et al. (Gerhardt et al., 1994), or in *Biotechnology: A Textbook of Industrial Microbiology by Brock* (Brock 1989). Yeast extract can be sourced from Angel (Yichang, China), Lesaffre (Marcq-en-Barceul, France), Ohly (Hamburg, Germany), DSM Food Specialities (Heerlen, Netherlands), Lallemand (Rexdale, Canada), Alltech Fermin (Nicholasville, KY), MC Food Specialties (Shinagawa-Ku, Japan), Yeastock (Tokyo, Japan), KOHJIN Life Sciences (Tokyo, Japan), Savoury Systems International (Branchburg, NJ), Sensient Technologies (Milwaukee, WI) or Kerry (Tralee, Ireland). All other reagents and materials used for the growth and maintenance of bacterial cells not specific mentioned were obtained from Aldrich Chemicals (Milwaukee, WI), BD Diagnostic Systems (Sparks, MD), Life Technologies (Rockville, MD), or Sigma Chemical Company (St. Louis, MO), unless otherwise specified.

Strains

The probiotic strain *Bifidobacterium animalis* supspecies *lactis* Bi-07 (also referred to as BBi) is a Gram-positive, rod-shaped, non-motile, anaerobic bacterium. It is available from ATCC as PTA SD5220. The strain has been sequenced and the sequence is available from NCBI under the accession number NC_017867 (Briczinski et al. 2009, Stahl and Barrangou 2012, Morovic et al. 2017). It is characterized by a 60.5% GC content.

*Lactobacillus acidophilus* NCFM is a Gram-positive, non-spore forming bacterium that was isolated in the 1970s from a human source and subsequently characterized in the food microbiology research laboratory at North Caroline State University (Sanders and Klaenhammer 2001). The strain has been shown to have beneficial effects on humans when ingested orally and has been sold commercially for more than 25 years. The strain is available from ATCC as 700396. The genome has been completely sequenced and is available from NCBI under the accession number NC_006814.3 (Altermann et al. 2005). The GC content of the genome is 39.1%.

Experimental Evolution

Strains were evolved towards improved storage stability essentially as described below. In general, replicated populations were serially transferred for about 100 generations in the selective environment before single colonies were isolated and tested for improved storage stability. Strains with improved storage stability in the spot plating assays were subsequently tested in the accelerated assay for fermentation performance, storage stability, changes in their metabolomic, fatty acid, and on occasion transcriptomic and proteomic profile. Whole genome sequencing was performed to identify mutations. For example, single populations were grown and transferred in De Man, Rogosa and Sharpe agar (MRS) broth before streaking the population on MRS agar and incubating the plates at high temperature to select for clones able to grow at high temperature. Alternatively, replicated populations could be selected under different conditions as follows:

To start replicated populations, single colonies were isolated and archived: Frozen stocks were plated onto MRS agar plates and grown under anaerobic conditions. Well isolated colonies were picked and grown in MRS broth to high density, supplemented with glycerol and frozen at −80° C. These frozen stocks of single colonies were then used to start replicated populations in MRS broth supplemented with cysteine HCl and a stressor, such as KCl, NaCl, SDS or increased temperature during incubation. All cultures were grown anaerobically either by covering the cultures with a breathable film in an anaerobic box or by covering the cultures with aluminum foil. Agar plates were incubated in anaerobic boxes with the appropriate number of anaerobic GasPak sachets for the size of the box used.

Selection experiments with replication were done as follows: Typically, six or eight replicated populations were grown in 7 mL MRS broth supplemented with cysteine (L-Cysteine HCl at a final concentration of 0.5 g/L added right before use) at a starting OD of 0.2-0.3 and grown for 24-48 hours either static or shaken at low speed (~100 rpms) before being transferred to fresh media. Unless temperature was the stressor, the cultures were grown at 37° C. in anaerobic conditions. The OD of several populations of the same selection regime was assessed and the populations were transferred at the same initial OD based on the average OD measured. The selection pressure was increased (i.e. increase concentration of stressor or increase the temperature) when the populations reached ODs after 24 hours that were similar to the ODs after 24 hours in benign conditions. If the populations could not make up the dilution rate, we decreased the stressor. A sample of the population was frozen at regular intervals by supplementing the sample with glycerol and storing the sample at −80° C. After ~100 generations, a sample of the population was supplemented with glycerol and frozen at −80° C. The number of generations per transfers was calculated as $$\text{Number of generations} = \frac{\log\left(\frac{\text{Final } OD}{\text{Initial } OD}\right)}{\log 2}$$

following Lenski et al. (Lenski et al., 1991).

Spot Plating Assay to Identify Storage-Stable Clones

To assess storage stability of the evolved clones, single colonies from the evolved populations were isolated and grown in benign, non-selective conditions, freeze dried and assessed for their viability relative to the ancestor after up to two weeks in an environmental chamber. To isolate single colonies, the colonies were either streaked or plated the evolved and ancestral populations on MRS agar plates and incubated in the anaerobic box with an anaerobic GasPak sachet. The streaked populations were incubated for 2 days before single colonies were isolated and restreaked onto fresh MRS agar plates and then incubated for another 2 days. To plate the populations on MRS agar plates, the cultures were diluted in a 10-fold dilution series and plated on MRS agar. After 2-3 days of incubations at 37° C. in the anaerobic box, single, well dispersed colonies were isolated and inoculated into fresh MRS broth in 48- or 96-well plates. The plates were sealed with adhesive aluminum foil and incubated for 24 hours at 37° C. and 100 rpm. The aluminum foil was carefully removed and the cells were resuspended by gently mixing the cultures using a multichannel pipettor or the Viaflo96 (ViaFlo 96, Integra Biosciences AG, Zizers, Switzerland). OD was measured and the cultures were diluted to OD 0.2 into 3.5 mL MRS broth in two new 48-well deep-well plate based the average OD. These plates were sealed with adhesive aluminum foil and incubated overnight at 37° C. and 100 rpm. At the same time, each clonal culture was supplemented with glycerol stocks for a final concentration of 20% glycerol and frozen at −80° C. for further analyses. This process was done for several single clones from replicated populations.

After incubation, the cells were prepared for storage by flash freezing and freeze drying as follows: The aluminum seals were removed and the cells were gently mixed into suspension in each well using the Viaflo96. OD was measured and based on average OD, the cultures were added to Cube2ubes (CUBE 2UBE® Tubes, Sigma BAF37851100) in racks (CUBE 2UBE® 96-well rack with cover, Sigma BAF378560000) in a 96-well array at a volume equivalent to 1 mL at OD 4. At least four Cube2ube per culture were prepared to be able to assess the clones' viability at different time points. The cells were chilled on ice for 30 min and subsequently centrifuged in the Multifuge X3R (ThermoFisher) at 4° C. and 3500 rpm for 10 minutes. All but 50 µL of the supernatant was removed using the ViaFlo96, 8 µL of potassium phosphate stabilizer (8 g monopotassium phosphate and 10.2 g dipotassium phosphate per 100 mL) was added to each Cube2ube, and well mixed with the cells by shaking the cultures for for 20 seconds at 2000 rpm on the Thermomixer C. After letting the cells rest at room temperature for 10 min and briefly mixing them at 2000 rpm for 15 seconds, the Cube2ubes were transferred in their box into liquid nitrogen for flash freezing, before placing them into a lyophilizer for 24-72 hours for freeze drying. The cubes were then placed into the environmental chamber and stored open (without a cover) at 30° C. and 40% humidity. The viability of the stored cells was assessed at regular intervals and compared to the viability of freeze dried but not stored cells as follows: One set of freeze dried cultures, the pre-storage set, was plated after lyophilization. All plating was done by resuspending the cells in 210 µLMRS, mixing the cells at 2000 rpm for 20 seconds, letting them sit for 30 minutes at room temperature and mixing them again at 2000 rpm for 15 seconds before diluting the cultures in a 10 fold titration series. 5 µL of certain dilutions were spotted (e.g. $10^{-6}$, $10^{-4}$, $10^{-2}$ and $10^{0}$) on MRS agar plates in OmniTrays from Fisher (OmniTray Single Well w/Lid, Sterile PS 242811). After the plated spots had dried, the plates were placed into an anaerobic box with a GasPak anaerobic sachet and incubated for 2-3 days at 37° C. After incubation, the highest dilution at which a clone was able to grow was recorded and pictures of the plates were taken. Other sets were removed, resuspended, and spotted and plated in the same way. Dilutions for plating were chosen based on the expected viability. The cultures were plated at different time intervals, typically after 0, 96, 168, 240 or 320 hours in the environmental chamber.

Clones with good survival during the spot plating assay were subsequently tested in more details in the accelerated assays and sequenced using whole genome sequencing to identify mutations that evolved over the course of the selection experiment. To maintain evolutionary independence, improved clones from different populations were picked for testing in the accelerated assay. This approach made it possible to employ a comparative approach based on parallel evolution to identify potentially beneficial mutations (Saxer et al. 2014). Storage stability in the Accelerated Assays was tested under dry conditions (50° C., no humidity), wet conditions (30° C. and 40% humidity) and in long-term storage (4 months) at 30° C. and low humidity. Any clones tested in the spot plating assay were used to make a freezer vial lot by growing the strain up and freezing it after supplementing 20% glycerol.

Bioreactor Cultivations

The fermentation system was custom-built and comprised 12 350 mL jacketed CelStir spinner flasks (Wheaton Science Products, Millville, NJ) each equipped with an autoclavable glass probe (Cole-Parmer, Vernon Hills, IL) and an IKA ColorSquid magnetic stirrer (Cole-Parmer, Vernon Hills, IL). 4 vessels each were temperature controlled by an Isotemp 4100 R20 Circulator (Thermo Fisher Scientific, Waltham, MA), respectively. Eutech Alpha pH 200 controllers (Thermo Fisher Scientific, Waltham, MA) were attached to BioChem Valve micro-pumps (Biochem Fluidics, Boonton, NJ) with a 20 µL dispense volume for pH control. PH and base additions were recorded in LabVIEW (National Instruments, Austin, TX) via LabJack T7 Pro data acquisition units (DAQ) (LabJack, Lakewood, Colorado). Fermentation settings are described in Table 1. At the end of a fermentation run, pH set point in the fermenter was changed to the neutralization pH and temperature set point to the "temperature after neutralization" value and cultures kept at this condition for 1 h.

TABLE 1

Fermentation settings in fermentation runs

| | NCFM | BBi |
|---|---|---|
| pH set point [ ] | 5.6 | 5.8 |
| temperature set point [° C.] | 38 | 38 |
| base for pH control | 50% NH4OH | 50% NH4OH |
| stirrer speed [rpm] | 200 | 200 |
| neutralization pH [ ] | 6.5 | 6.5 |
| temperature after neutralization [° C.] | 10 | 10 |

Media

Composition of the media used in shake flask experiments and in bioreactor cultivations of the strains is given in Table 2. Water was taken from the public water system (Experimental Station, Wilmington, DE). Media were adjusted before autoclaving to pH=6.8 with 50% NH4OH solution for BBi and NCFM, and with 20% NaOH solution for LPC37, respectively. The media were autoclaved in an Amsco 3043 Jacketed Steam Sterilizer/Autoclave (Steris, Mentor, OH) for 20 min at 121° C. in portions of 800 mL contained in 1 L glass bottles (Corning Pyrex 1399-1000). For BBi, cysteine-HCl was added to the medium after heat sterilization.

Seed Cultures

The seed train of NCFM® comprised three steps. A 15 mL Falcon™ tube filled with 14 mL of NCFM® medium (Table 2) was inoculated with 1 mL of frozen-stock culture. The tube was capped and incubated at 38° C. with no agitation for 8 h in an Innova 4230 incubator (New Brunswick Scientific, Enfield, CT) until reaching OD600 values of approximately 1.000. For the second stage inoculum 100 mL medium (Table 2) in a 125 mL Fisherbrand flat bottom closed cap flask (Thermo Fisher Scientific, Waltham, MA), i.e. seed flask 2, was inoculated and subsequently incubated at 38° C. with no agitation for 16 h in an Innova 4230 incubator (New Brunswick Scientific, Enfield, CT). Targeted OD after inoculation was 0.078. At the end of the incubation time of seed flask 2, pH was measured and only cultures with pH between 4.0-4.4 were used for next transfer. Inoculum volume for the third transfer was calculated for 100 mL medium (Table 2) in a 125 mL plain bottom flask (seed flask 3). Target OD600 was 1.766. If at the end of the incubation pH was found higher than 4.4 or OD lower than 3, additional time was provided for growth of the culture to reach a pH of 4.0-4.4 and an OD of 3-4 before transfer into a bioreactor. OD measurements were carried out at 600 nm (OD600) with a Helios Alpha spectrophotometer (Thermo Fisher Scientific, Waltham, MA).

The seed train of BBi comprised three steps. A 15 mL Falcon™ tube containing 14 mL of BBi medium (Table 2) was inoculated with 1 mL of frozen-stock culture. The Falcon™ tube was capped and incubated at 38° C. with no agitation for 8 h in an Innova 4230 incubator (New Brunswick Scientific, Enfield, CT). The second stage inoculated 100 mL medium (Table 2) in a 125 mL Fisherbrand flat bottom closed cap flask (Thermo Fisher Scientific, Waltham, MA) to a target OD600 of 0.078. Subsequently the flask was incubated at 38° C. with no agitation for 16 h in an Innova 4230 incubator (New Brunswick Scientific, Enfield, CT). At the end of the incubation, pH was measured and only cultures with pH between 4.0-4.4 used for transfer into seed flask 3. Target OD was 1.766 in a 125 mL plain bottom flask filled with 100 mL medium (Table 2). If at the end of the incubation pH was found higher than 4.4 or OD lower than 3, additional time was provided for growth of the culture to reach a pH of 4.0-4.4 and an OD of 3-4 before transfer into a bioreactor. OD measurements were carried out at 600 nm (OD600) with a Helios Alpha spectrophotometer (Thermo Fisher Scientific, Waltham, MA).

TABLE 2

Medium composition used for NCFM and BBi.

| component [ ] | NCFM [g] | BBi [g] |
|---|---|---|
| water (145 F. +/− 5 F.) | 918.95 | 930.00 |
| Dextrose | — | 15.00 |
| corn syrup solids | — | 18.00 |
| Sucrose | 45.95 | — |
| yeast extract | 22.98 | 22.50 |
| cysteine-HCl | — | 0.50 |
| magnesium sulfate | 6.43 | 7.00 |
| ascorbic acid | 0.92 | 1.00 |

TABLE 2-continued

Medium composition used for NCFM and BBi.

| component [ ] | NCFM [g] | BBi [g] |
|---|---|---|
| vitamin B12 | 0.09 | 0.10 |
| manganese sulfate | 0.09 | 0.10 |
| polysorbate (Tween) 80 | 4.59 | 5.00 |

Analytical Methods

OD600 was determined with a Helios alpha spectrophotometer (P/N 9423 UVA 1202E, Thermo Fisher Scientific, Waltham, MA). If the observed absorbance $A_{sample}$ exceeded a value of 0.3, cultures were diluted with 0.9% NaCl to below 0.3 applying dilution factor DF. Optical density of broth without cells $OD_{broth}$ was determined after spinning 1 mL of culture for 2 min at 16 000 rpm in an Eppendorf table top centrifuge (Eppendorf, Germany). OD600 was finally calculated according to:

$$OD_{600} = DF \times (A_{sample} - A_{NaCl}) - (OD_{broth} - A_{NaCl})$$

For determination of cell dry weight concentration, a culture volume $V_{filtered}$ of either 2 or 3 mL, depending on the cell concentration (i.e. for OD600>10 2 mL were chosen, and for OD600 below 10 3 mL) were filtered through Nylaflo filters (pore size 0.25 µm, diameter 47 mm, VWR Cat No 28140-040) placed on a fritted disc with diameter 47 mm of a Synthware Filtration Apparatus with [ST]40/35 joint connections (VWR cat #60002-266, Kemtech America, Pleasant Prairie, WI). The filter with filter cake was subsequently washed with 0.9% NaCl solution of equivalent volume as the filtered culture, moved to an aluminum pan and placed in an oven for drying at 80° C. for 24 h. Subsequently the weight of the dried filter with filter cake in the aluminum pan, $w_{dry}$, was determined and the original weight $w_0$ of filter and pan as determined prior to the experiment subtracted. Additionally, the weight was corrected for the weight difference before and after drying of reference filters only washed with 0.9% NaCl solution, $w_{rf}$. Concentration of cell dry weight cdw was determined according to:

$$cdw = \frac{w_{dry} - w_0 - w_{rf}}{V_{filtered}}$$

Usually cell dry weight concentration was the result from averaging three independent measurements.

Concentration of colony forming units, CFU, in a culture was generally determined at end of a fermentation run (EOR) and/or after a "conditioning" process termed "cold neutralization" (CN). Two mL of either EOR or CN culture were transferred in a 5 mL Eppendorf tube and sonicated with a Q125 sonicator (Qsonica, Newtown, CT) with the CL-18 probe centered in the tube and half immersed in the culture liquid and being operated for 15 seconds at 40% amplitude.

The sonicated culture samples were serially diluted with sterile 0.1% peptone water in 99 mL Flip-Top Dilution Bottles (3M, St. Paul, MN) and pour plated in triplicate with MRS agar. MRS agar was usually prepared a week to 10 days ahead of plating. Briefly, 70 g of Difco Lactobacilli MRS broth with agar (Becton, Dickinson and Company, Franklin Lakes, NJ) was added to 1 l of ultrapure water, mixed and boiled for 1 minute. 200 mL of the MRS agar solution were portioned into 250 mL bottles, sterilized in a 20-minute autoclave liquid cycle and subsequently stored in a 48 C incubator until use. At the day of the experiment, the bottles were transferred to a water bath tempered at 46° C. If the cells required cysteine (e.g. BBi or NCFM), 2 mL of 5% Cysteine-HCl solution was added to the 200 mL MRS agar solution. Cystein-HCl solution was prepared by dissolving cysteine-HCl powder in ultrapure water ad 250 mL, subsequently filter sterilizing the solution in a 250 mL Nalgene aPES filter unit with diameter 55 mm and pore size 0.2 µm (Thermo Fisher Scientific, Waltham, MA). After solidifying plates at RT in an aerobic environment for approximately 10 minutes, plates were turned over and stored in standard (up to 18 plates) or large (up to 33 plates) air-tight containers (GasPak EZ Container System, Becton, Dickinson and Company, Franklin Lakes, NJ), together with activated anaerobic pouches (GasPak EZ Container System Sachets, Becton, Dickinson and Company, Franklin Lakes, NJ) to create an anoxic atmosphere. The anaerobic containers were incubated for 44 h in an environmental chamber set to 38° C. Plates with the different dilutions were usually counted either by hand or, on some occasions, based on processing of images generated by a Flash & Grow colony counter (IUL Instruments, Barcelona, ES) with the image software Flash & Grow 1.3.

Downstream Processing in 96-Well "Small-Scale" Plate Assay 1 mL of approximately 200 mL of culture broth taken directly from bioreactor with subsequent pH-adjustment and storage for 1 h in a 10° C. water bath ("conditioning"), was transferred into tubes of a 96 plate (Nova Biostorage, Canonsburg, PA) with a Nimbus 96-head robot (Hamilton Robotics, Bonaduz, Switzerland) using 1 mL Axygen tips (Thermo Fisher Scientific, Waltham, MA). A minimum of 3, usually 8 tubes per plate and condition were filled. Number of plates was chosen in accordance with the executed stability testing program, and was usually 5 plates. The filled plates were centrifuged in Eppendorf 5810 R centrifuge equipped with a A-4-62 rotor at 10° C. and 4000 rpm for 10 minutes. Next supernatant was removed from each tube with a LiHA (8 channel) Freedom EVO robot (Tecan, Männedorf, Switzerland) using liquid sensing/conductive 1000 µL tips (Thermo Fisher Scientific, Waltham, MA). Finally, stabilizer was added using MCA 200 µL tips (Thermo Fisher Scientific, Waltham, MA). The stabilizer solutions were made within 24 h prior to the experiment. The standard amounts of supernatant removed and stabilizer added for strains BBi, BBI, LPC37 and NCFM® are given in Table 3 and Table 4, respectively.

TABLE 3

Volume of supernatant removed, type and volume of stabilizer added for strains LPC37, NCFM and BBi in 96-well "small scale" plate assay

| strain | V(removed supernatant) [µl] | stabilizer | V(stabilizer) [µl] |
|---|---|---|---|
| LPC37 | 940 | A-TKP | 30.0 |
| NCFM | 955 | TKP | 22.5 |
| BBi | 950 | SKP | 15.0 |

TABLE 4

Composition of applied stabilizers A-TKP, TKP and SKP in 96-well "small scale" plate assay

| stabilizer | water [g] | sucrose [g] | trehalose [g] | KH2PO4 [g] | K2HPO4 [g] | total [g] |
|---|---|---|---|---|---|---|
| A-TKP | 40.9 | — | 39.1 | — | 19.9 | 100.0 |
| TKP | 41.9 | — | 40.0 | 8.0 | 10.2 | 100.0 |
| SKP | 41.9 | 40.0 | — | 8.0 | 10.2 | 100.0 |

Cell pellets and stabilizer solutions were mixed with a V shape stir element (V&P Scientific, San Diego, CA) in a magnetic tumbler (V&P Scientific, San Diego, CA) at 200 rpm for approximately 2 minutes. Subsequently the tubes of the plates were transferred to 96 well aluminum microplate frames (SP Scientific, Gardiner, NY) previously stored on dry ice that were subsequently stored in −80° C. freezer. Aluminum frames with tubes were lyophilized in a VirTis Advantage freeze dryer (SP Scientific, Gardiner, NY) following program depicted in Table 5.

TABLE 5

Applied freeze-drying program in 96-well "small scale" plate assay. Abbreviations: Vac = applied vacuum; EPT = elapsed process time.

| | ramp/hold | temp [° C.] | time [h] | time [min] | vac [mT] | EPT [h] | EPT [min] |
|---|---|---|---|---|---|---|---|
| Step 1 | HOLD | −45 | 0.2 | 10.0 | 100 | 0.2 | 10.0 |
| Step 2 | RAMP | −22 | 1.0 | 60.0 | 100 | 1.2 | 70.0 |
| Step 3 | RAMP | 2 | 20.8 | 1250 | 100 | 22.0 | 1320 |
| Step 4 | RAMP | 32 | 10.0 | 600 | 100 | 32.0 | 1920 |
| Step 5 | HOLD | 32 | 20.8 | 1250 | 100 | 52.8 | 3170 |
| Step 6 | HOLD | 25 | 16.7 | 1000 | 50 | 69.5 | 4170 |

After completion of the program, tubes were transferred from the aluminum microplate frames into plastic boxes. The plate for determining cell counts without storage ("T0") was immediately transferred to a desiccator with relative humidity<1% and stored at room temperature for 1 h before further processing.

Storage Stability Testing in 96-Well "Small-Scale" Plate Assay at 30° C. and 40% Relative Humidity After completion of the freeze-drying program, tubes were transferred from the aluminum microplate frames into plastic boxes. For storage stability testing in 96-well "small scale" plate assay at 30° C. and 40% relative humidity, plastic boxes with open tubes were transferred into either a model 7000-33-1 or 6040-1 Caron environmental chamber (Caron, Marietta, OH) set to 30° C. and 40% relative humidity and stored until sampling.

Storage Stability Testing in 96-Well "Small-Scale" Plate Assay at 50° C. and Low Relative Humidity After completion of the freeze-drying program, tubes were transferred from the aluminum microplate frames into plastic boxes. For storage stability testing in 96-well "small scale" plate assay at 50° C. and low relative humidity, plastic boxes with open tubes were transferred into a desiccator with relative humidity<1% and stored at 50° C. until sampling.

Storage Stability Testing in 96-Well "Small-Scale" Plate Assay at 30° C. and Low Relative Humidity After completion of the freeze-drying program, tubes were transferred from the aluminum microplate frames into plastic boxes. For storage stability testing in 96-well "small scale" plate assay at 30° C. and low relative humidity, plastic boxes with open tubes were transferred into a desiccator with low relative humidity<1% and stored at 50° C. until sampling.

Cell Revival and Plating in 96-Well "Small-Scale" Plate Assay

One mL MRS media was added to each sample tube with a Nimbus 96-head robot (Hamilton Robotics, Bonaduz, Switzerland). Subsequently the filled tubes (still containing the stirrer bars) were agitated on a magnetic tumbler (V&P Scientific, San Diego, CA) for 25 min at 300 rpm, then for another 5 min at 600 rpm. In the meantime, a Nimbus 96-head robot (Hamilton Robotics, Bonaduz, Switzerland) was used to add 900 µL peptone water into 7×96 Corning 96-well clear V-bottom 2 mL polypropylene deep well plates #3960 (Corning Inc., Corning, NY). After mixing, the Nimbus 96-head robot was used to create serial dilutions by repeatedly transferring 100 µL sample volume into the 900 µL peptone water, followed by aspiration. For each sample, usually 3 most significant dilutions were chosen, per each dilution usually three samples with variable volume each of 50-200 uL transferred onto plates, MRS agar poured on top of it, and subsequently the solutions in the plate well mixed. MRS agar was usually prepared a week to 10 days ahead of plating. Briefly, 70 g of Difco Lactobacilli MRS broth with agar (Becton, Dickinson and Company, Franklin Lakes, NJ) was added to 1 L of ultrapure water, mixed and boiled for 1 minute. 200 mL of the MRS agar solution were portioned into 250 mL bottles, sterilized in a 20-minute autoclave liquid cycle and subsequently stored in a 48 C incubator until use. At the day of the experiment, the bottles were transferred to a water bath tempered at 46 C. If the cells required cysteine (e.g. BBi or NCFM), 2 mL of 5% Cysteine-HCl solution was added to the 200 mL MRS agar solution. Cystein-HCl solution was prepared by dissolving cysteine-HCl powder in ultrapure water ad 250 mL, subsequently filter sterilizing the solution in a 250 mL Nalgene aPES filter unit with diameter 55 mm and pore size 0.2 µm (Thermo Fisher Scientific, Waltham, MA). After hardening plates at RT in an aerobic environment for approximately 10 minutes, plates were turned over and stored in standard (up to 18 plates) or large (up to 33 plates) air-tight containers (GasPak EZ Container System, Becton, Dickinson and Company, Franklin Lakes, NJ), together with activated anaerobic pouches (GasPak EZ Container System Sachets, Becton, Dickinson and Company, Franklin Lakes, NJ) to create an anoxic atmosphere. The anaerobic containers were incubated for 44 h in an environmental chamber set to 38° C. Plates with the different dilutions were usually counted either by hand or, on some occasions, based on processing of images generated by a Flash & Grow colony counter (IUL Instruments, Barcelona, ES) with the image software Flash & Grow 1.3.

Statistical Processing of CFU Counts

As it is well established that CFU results are less accurate with high and low colony counts on a single plate $CFU_{count}$ a weighting function was introduced giving results of a sample with $CFU_{count}>300$ or $CFU_{count}<20$ lower weight, according to:

$$CFU_{count} > 300: \quad w_{count} = 1/[1+(CFU_{count}\text{-}300)/50]$$

$$300 \geq CFU_{count} \geq 25: \quad w_{count} = 1$$

-continued $$20 > CFU_{count} > 0: \quad w_{count} = CFU_{count}/20$$

$$CFU_{count} = 0: \quad w_{count} = 0.02$$

Next a single outlier detection on all n $CFU_{count}$ from a well was carried out based on the Dixon Q test for all data sets n>3. Depending on the number of suspected outliers, different ratios are used to identify potential outliers. Briefly, the n $CFU_{plate}$ values x1 to xn were ordered such that x1<x2< ... <xn−1<xn and their corresponding ratio(r)-values for the lowest and highest value were determined according to:

$$\text{lowest value: } r(l)_{10} = \frac{x_2 - x_1}{x_n - x_1}$$

$$\text{highest value: } r(h)_{10} = \frac{x_n - x_{n-1}}{x_n - x_1}$$

The determination of the ratios was modified to ensure that even for arrays that exhibit only minimal deviations in their measurements the denominator xn-x1 was always at minimum 1% of xn. If $r(l)_{10}$ or $r(h)_{10}$ exceeded a critical value $r_{10}(conf)_{crit(number)}$ the corresponding measurement was neglected in further analysis. The confidence interval was set at conf=90% and respective critical values for the total number of measurements n from the well/experiment $r(90\%)_{crit(n)}$ were taken from Verma and Quiroz-Ruiz (Verma and Quiroz-Ruiz 2006). If both of the calculated values $r(l)_{10}$ and $r(h)_{10}$ were above the critical value, only the measurements yielding the larger r-value was excluded. If 8 or more observations were available per well, in addition to the single outlier detection the lowest and the highest measurement were analyzed for both being outliers. Therefor their r-values were calculated according to:

$$\text{lowest value: } r(l)_{11} = \frac{x_2 - x_1}{x_{n-1} - x_1}$$

$$\text{highest value: } r(h)_{11} = \frac{x_n - x_{n-1}}{x_n - x_2}$$

The denominators xn−1−x1 or xn−x2 were again kept at a minimum of 1% of the second largest value xn−1. Similar to the previously described procedure, if r(l)11 or r(h)11 exceeded a critical value $r11(conf)_{crit(number)}$ (Verma and Quiroz-Ruiz 2006) with 90% confidence the corresponding measurements were left out in subsequent analyses. Overall, from the n plates counted for a well, n' values passed the outlier test.

Finally, the weighted average CFU count per well, wCFUwell, and associated weighted experimental standard deviation, wSDwell,exp, was calculated per well according to $$\overline{wCFU}_{well} = \frac{\sum_{1}^{n'} w_{count,i} \cdot CFU_{count,i}}{\sum_{1}^{n'} w_{count,i}}$$

and $$wSD_{well,exp} = \sqrt{\frac{n' \cdot \sum_{i=1}^{n} w_{count,i} \cdot (CFU_{count,i} - \overline{wCFU}_{well})^2}{(n'-1) \cdot \sum_{i=1}^{n} w_{count,i}}},$$

respectively. The standard error of the mean SEMwell was subsequently determined according to:

$$SEM_{well,exp} = \frac{wSD_{well,exp}}{\sqrt{n'}},$$

In subsequently analysis only the higher value from the pair of the experimentally determined and the theoretically minimum standard error of the mean was carried forward, according to:

$$SEM_{well} = \max(SEM_{well,exp}, SEM_{well,min})$$

Finally, the weights of the individual plate counts were aggregated into a quality score for the well with:

$$QS_{well} = \frac{\sum_{k=1}^{n'} w_{count,i}}{n'}$$

Next, results from all the m wells representing the same condition were grouped (at least 3, usually 8 wells per condition) and again subjected to the same Dixon-type outlier detection process as described previously (resulting in m' accepted values). The weighted average CFU count per condition, wCFUcond, and associated weighted experimental standard deviation, wSDcond,exp, was calculated per condition according to:

$$\overline{wCFU}_{cond} = \frac{\sum_{1}^{m'} QS_{well,i} \cdot \left(\frac{3}{rSEM_{well,i}}\right)^2 \cdot CFU_{well,i}}{\sum_{1}^{m'} QS_{well,i} \left(\frac{2}{rSEM_{well,i}}\right)^2}$$

and $$wSD_{well,cond} = \sqrt{\frac{m' \sum_{1}^{m'} QS_{well,i} \cdot \left(\frac{1}{rSEM_{well,i}}\right)^2 \cdot (CFU_{well,i} - \overline{wCFU}_{well,i})^2}{(m'-1) \cdot \sum_{1}^{m'} QS_{well,i} \left(\frac{1}{rSEM_{well,i}}\right)^2}},$$

Whereas rSEMwell,i represented the relative standard error of the mean for a well in percent. The standard error of the mean for wCFUcond was subsequently calculated according to:

$$SEM_{cond} = \frac{wSD_{well,cond}}{\sqrt{m'}}.$$

Error Propagation

When a function was a set of non-linear combination of several parameters, y=f(x1, x2, ..., xi), the function was linearized by approximating a first-order Taylor series expansion and the error interval calculated according to:

$$\Delta y = \frac{\delta y}{\delta x_1} \cdot \Delta x_1 + \frac{\Delta y}{\Delta x_2} \cdot \Delta x_2 + \ldots + \frac{\delta y}{\delta x_i} \cdot \Delta x_i$$

For example, the percent survival of cells at a given time point T, SV(T), and its standard error of the mean, SEM (SV(T)), was determined according to $$SV(T)[\%] = \frac{\overline{CFU_T}}{\overline{CFU_{T_0}}} \cdot 100\%$$

$$SEM(SV(T))[\%] = \pm \left( \frac{SEM(\overline{CFU_T})}{\overline{CFU_{T_0}}} + \frac{\overline{CFU_T}}{\overline{CFU_{T_0}}^2} \cdot SEM(\overline{CFU_{T_0}}) \right) \cdot 100\%$$

Whole Genome Sequencing

Any strain that was tested for storage stability in the accelerated assay was also analyzed at the genomic level using whole genome sequencing. DNA was extracted using the MoBio PowerSoil kit and submitted for sequencing on MiSeq. The paired-end reads were aligned to the reference sequence using the pipeline breseq (Deatherage and Barrick 2014). Both the ancestor and evolved clones were sequenced. Only mutations that occurred in the evolved clones were considered. Any mutations that were present in the ancestral strain were disregarded as sequencing errors in the reference sequence or differences between our ancestor and the reference sequence.

Example 1

Figure 1:
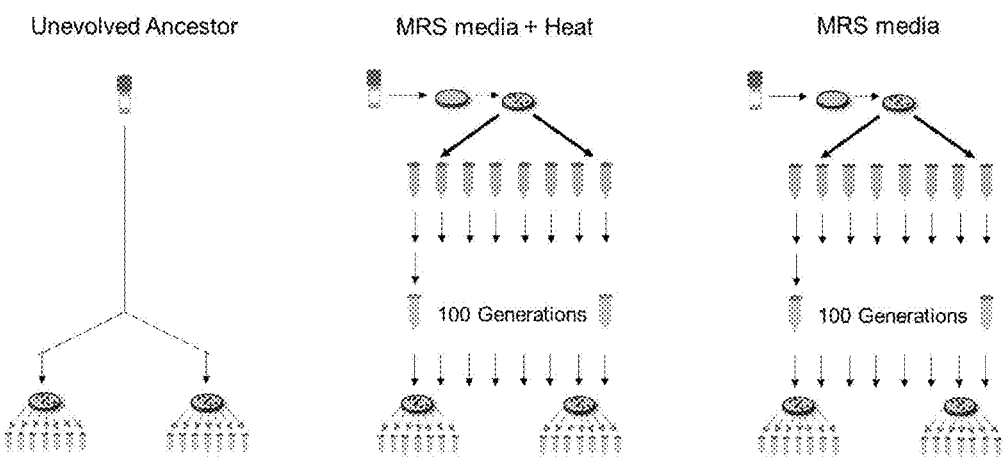
FIG. 1 is a cartoon describing the experimental outline to test whether selection for growth at increased temperature leads to improved storage stability.

Adaptation to Increased Heat Results in Increased Storage Tolerance for *Bifidobacterium animalis* Supspecies *lactis* BBi Adaptation to heat results in a higher frequency of storage stable clones than selection in the media alone. Replicated populations of *Bifidobacterium animalis* subspecies *lactis* were started with a single clone and evolved for ~100 generations by daily transfers into fresh media in different conditions. One set of populations were evolved in De Man, Rogosa and Sharpe (MRS) broth supplemented with L-Cysteine HCl (Sigma C1276, CAS 52-89-1) at a final concentration of 0.5 g/L at a constant temperature of 37° C. while a second set was evolved in the same media but at increasing temperatures. The populations were transferred by diluting them to a starting OD between 0.2 and 0.3. After ~100 generations of selection, samples of the evolved populations were frozen at −80° C. for further analyses. Two randomly selected populations from each treatment were serially diluted and plated onto MRS agar plates, and incubated at 37° C. under anaerobic conditions for two days. The ancestral strain was also grown from the freezer, diluted, plated onto MRS agar plates, and incubated along with the evolved populations. After incubation, 16 randomly selected single clones were isolated from each evolved population and two sets of 16 single clones were isolated from the ancestral populations (FIG. 1). These clones were subsequently grown in MRS media. After growth, the cells were spun down, the supernatant removed, KP stabilizer added, before the cell pellets were flash frozen and freeze fried, and subsequently exposing to 50° C. and 0% humidity for 22 days. For each clone, the number of viable cells were assayed after freeze drying and after storage at 50° C. by eluting the pellet in MRS media, plating serial dilutions onto MRS agar plates and counting the number of colony forming units per plate as described in the general methods.

Figure 2:
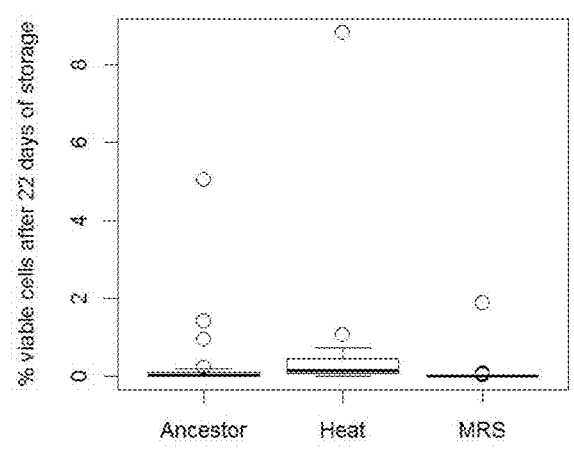
FIG. 2 is a graph showing the percent of viable cells per ancestral or evolved clone after storage at 50° C. for 22 days based on viable cells before storage.

Overall, the frequency of strains with increase survival during storage was higher in the heat evolved populations than among the ancestral clones or the MRS evolved populations (FIG. 2)

Example 2

Experimental Evolution of *Bifidobacterium animalis* Supspecies *lactis* BBi

Six replicate populations were started from a single clones of the probiotic strain *Bifidobacterium animalis* supspecies *lactis* BBi (Bi-07 DuPont—henceforth referred to as BBi) and evolved for growth at increasingly higher temperature as described in the general methods.

The populations were inoculated at an initial OD of 0.3 in 7 mL MRS broth supplemented with cysteine in 24-well blocks covered with adhesive aluminum foil and incubated at 42° C. and 100 rpm. The populations were transferred the daily with a few exceptions when the incubation lasted up to 70 hours and inoculated at the same initial OD. The number of generations per day was calculated as (Lenski et al. 1991):

$$\text{Number of generations} = \frac{\log\left(\frac{\text{Final } OD}{\text{Initial } OD}\right)}{\log 2}$$

After six transfers grown at 42° C., the incubation temperature was raised to and kept at 44° C. for the remainder of the selection experiment. At least once a week, a sample of each population was supplemented with glycerol (20% final concentration) and frozen at −80° C. After approximately 100 generations of selection, the populations were supplemented with glycerol and frozen at frozen at −80° C. for further evaluations.

All six parallel populations were evolved in the same way and the stressors were increased in all the populations at the same time. None of the populations went to extinction.

Example 3

Small-Scale Evaluation of Evolved *Bifidobacterium animalis* Supspecies *lactis* Bi-07

After the selection experiment, Applicants isolated single clones from the evolved populations and tested their storage stability in spot plating assays as described in the general methods. The spot plating assay sacrifices precision for high through-put: instead of assessing CFUs, Applicants focused on log 10 changes in viability of a freeze-dried sample relative to the ancestor after different storage intervals. Single clones were isolated by plating the evolved populations on MRS agar plates. The clones were grown to high density and flash frozen after adding KP stabilizer to the cell pellet. After freeze drying, the dry cell pellets were stored in the environmental chamber at 30° C. and 40% humidity and the cell viability was assessed after different storage times and compared to the viability of the ancestral control strains. Per population Applicants assessed up to seven single clones.

Two clones from two independent populations evolved for increased heat-tolerance showed consistently higher storage stability than the ancestor after 120 and 264 hours. These clones were named BBi Heat 4.1 and BBi Heat 6.6 and evaluated in the accelerated assay to test their fermentation performance and subsequent storage stability. At the same time, their genome was sequenced to identify mutations that arose over the course of the selection experiment.

Example 4

Performance of Strains BBi Heat 6.6

Seed cultures of BBi Wildtype C1 and BBi Heat 6.6 were generated following the three-step seed culture protocol as described in the General methods. Of the second stage seed cultures, 7 mL were inoculated into 343 mL of BBi medium (Table 2). One vessel each was inoculated with BBi Wildtype C1 and BBi Heat 6.6, respectively. BBi Wildtype C1 was harvested after 17.93 h and BBi Heat 6.6 after 17.81 h. Final cell dry weight concentrations for the BI Wildtype C1 were 3 cell g/l whereas the BBi heat 6.6 strain were at 7 g/l indicating an improvement due to evolution.

Cultures of BBi Wildtype C1 and BBi Heat 6.6 were harvested into 500 mL shake flasks, capped and stored for 1 h in a 10° C. water bath. Cell concentrations determined after storage indicated that the wildtype had a cell concentration of about $1.175 \times 10^{10}$ CFU/mL and the heat 6.6 strain had a cell concentration of about $1.35 \times 10^{10}$ CFU/mL.

Example 5

Performance of BBi Heat 6.6 Heat in Downstream Processing

Sample material generated in Example 3 was processed following the protocol described in the General Methods under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

Analysis indicated strain BBi Heat 6.6 demonstrated about 75% survival whereas the BBi Wildtype C1 control only demonstrated about a 50% survival under the stated assay conditions.

Example 6

Storage Stability of BBi Heat 6.6 Heat

Sample material generated in EXAMPLE 5 was stored at 40% relative humidity and 30° C. following the protocol described under "Storage stability testing in 96-well "small-scale" plate assay at 30° C. and 40% relative humidity" in the General Methods. Subsequently the material was tested for its CFU content after storage at 30° C. and 40% relative humidity for either 14 d (CFU (storage, 30 C, wet, 14 d)) or 28 d (CFU (storage, 30 C, wet, 28 d)), applying the methods described for cell survival, plating and statistical processing in the general method section. Survival (storage, 30 C, wet, X) for respective storage time X was calculated according to $$\text{survival(storage, 30}C\text{, wet, }X) = \frac{CFU(\text{storage, 30}C\text{, wet, }X)}{CFU(T0)}$$

It was found that strains BBi Heat 6.6 had significant improved survival, i.e. significantly improved storage stability as compared to BBi Wildtype C1, if stored at 30° C. and 40% relative humidity for either 14 d or 28 d, where the BBi Wildtype C1 showed about 7.5% survival at both 14 and 287 days whereas the BBi Heat 6.6 strain demonstrated on the order of 24% survival at 14 days and 20% survival at 28 days.

Sample material generated in EXAMPLE 5 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for either 7 d (CFU (storage, 50 C, dry, 7 d)) or 14 d (CFU (storage, 50 C, dry, 14 d)), applying the methods described for cell survival, plating and statistical processing in the general method section. Survival (storage, 50 C, dry, X) for respective storage time X was calculated according to $$\text{survival(storage, 50}C\text{, dry, }X) = \frac{CFU(\text{storage, 50}C\text{, dry, }X)}{CFU(T0)}$$

It was found that strains BBi Heat 6.6 had significant improved survival, i.e. significantly improved storage stability as compared to BBi Wildtype C1, if stored at 50° C. and low relative humidity for either 7 d or 14 d, where the BBi Wildtype C1 demonstrated 10% at 7 days and 5% survival at 14 days under the stated conditions whereas the BBi Heat 6.6 strain demonstrated 30% survival at 7 days and on the order of 18% survival at 14 days under the stated conditions.

Example 7

Effective Productivity of BBi Heat 6.6 Heat for Different Storage Conditions

From cultivating the strains as described in Example 4 processing the strains as described in Example 5 and analyzing the strains as described in EXAMPLE, the information was gained to derive the effective productivity of the strains according to:

$$P_{eff} = \frac{\Delta\ CFU}{\Delta\ t_{fermentation}}$$

Figure 3:
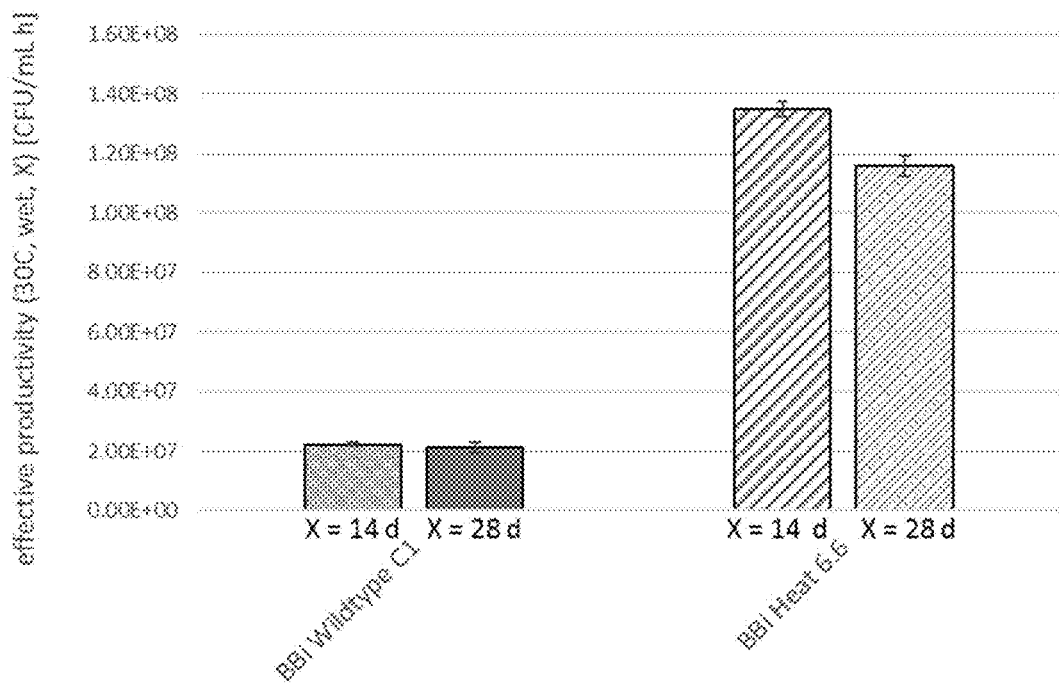
FIG. 3 is a graph showing the effective productivity of cultures BBi Wildtype C1 if subsequently stored for either X=14 d (dotted grey) or X=28 d (solid grey) as well as of BBi Heat 6.6 if subsequently stored for either X=14 d (thick diagonal stripes upward) or X=28 d (thin diagonal stripes upward) at 30 C and 40% relative humidity.

In the present example, for ΔCFU the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for either 14 d or 28 d at 30° C. and 40% relative humidity, strain BBi Heat 6.6 exhibited significantly higher effective productivity than BBi Wildtype C1 (FIG. 3)

Figure 4:
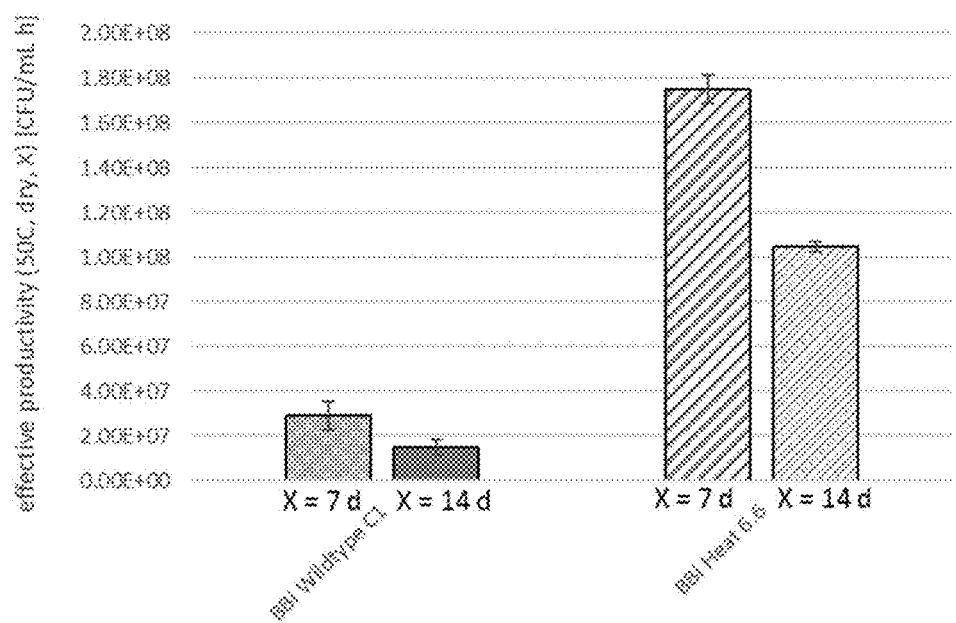
FIG. 4 is a graph showing the effective productivity of cultures BBi Wildtype C1 if subsequently stored for either X=7 d (dotted grey) or X=14 d (solid grey) as well as of BBi Heat 6.6 if subsequently stored for either X=7 d (thick diagonal stripes upward) or X=14 d (thin diagonal stripes upward) at 50 C and low relative humidity.

The effective productivity determination was carried out with the strains cultivated as described in Example 4 processed as described in Example 5 and stored for either 7 d or 14 d at 50° C. at low relative humidity as described in Example 6 It was found that strain BBi Heat 6.6 exhibited significantly higher effective productivity than BBi Wildtype C1 (FIG. 4).

Example 8

Performance of Strains BBi KCl 1.2, BBi KCl 5.5, BBi NaCl 2.7, BBi NaCl 3.3, BBi NaCl 5.1 and BBi NaCl 6.2

Figure 5:
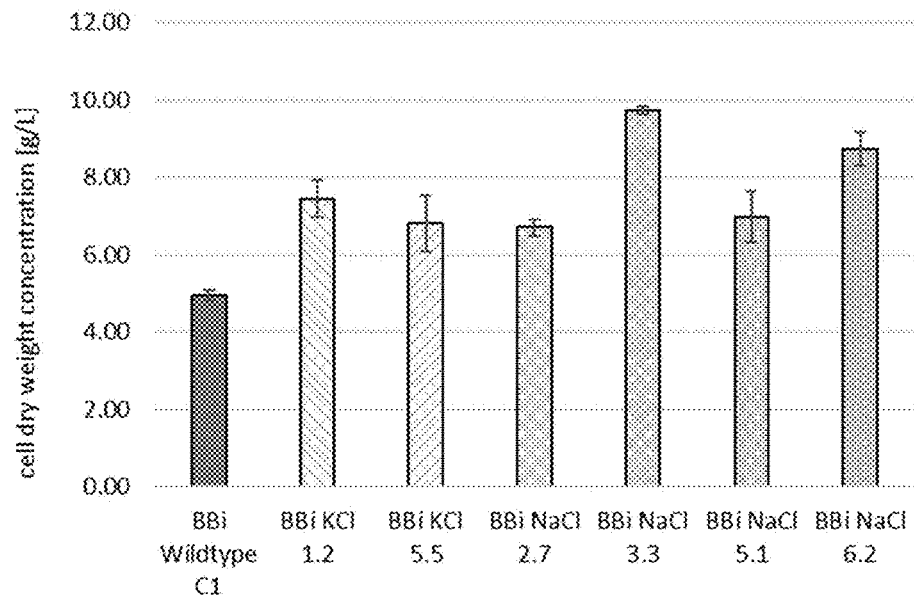
FIG. 5 is a graph showing the cell dry weight concentration measured at harvest time in cultures of BBi Wildtype C1 (solid dark grey), BBi KCl 1.2 (diagonal stripes downward), BBi KCl 5.5 (diagonal stripes upward), BBi NaCl 2.7 (50% dotted), BBi NaCl 3.3 (60% dotted), BBi NaCl 5.1 (70% dotted) and BBi NaCl 6.2 (80% dotted).

Seed cultures of BBi Wildtype C1 and BBi KCl 1.2, BBi KCl 5.5, BBi NaCl 2.7, BBi NaCl 3.3, BBi NaCl 5.1 and BBi NaCl 6.2 were generated following the three-step seed culture protocol as described in the "general method" section. Of the second stage seed cultures, 7 mL were inoculated into 343 mL of BBi medium (Table 2). One vessel each was inoculated with BBi Wildtype C1 and BBi KCl 1.2, BBi KCl 5.5, BBi NaCl 2.7, BBi NaCl 3.3, BBi NaCl 5.1 and BBi NaCl 6.2, respectively. BBi Wildtype C1 was harvested after 17.93 h, BBi KCl 1.2 after 15.65 h, BBi KCl 5.5 after 15.58 h, BBi NaCl 2.7 after 15.55 h, BBi NaCl 3.3 after 15.61 h, BBi NaCl 5.1 after 15.59 h and BBi NaCl 6.2 after 15.59 h. Final cell dry weight concentrations at harvest are shown in FIG. 5.

Cultures of BBi Wildtype C1 and BBi KCl 1.2, BBi KCl 5.5, BBi NaCl 2.7, BBi NaCl 3.3, BBi NaCl 5.1 and BBi NaCl 6.2 were harvested into 500 mL shake flasks, capped and stored for 1 h in a 10 C water bath. Cell concentrations as measured in CFU/mL correlated strongly with the cell dry wt. data as shown in FIG. 5.

Example 9

Performance of Strains BBi KCl 1.2, BBi KCl 5.5, BBi NaCl 2.7, BBi NaCl 3.3, BBi NaCl 5.1 and BBi NaCl 6.2 in Downstream Processing Sample material generated in Example 8 was processed following the protocol described in the general method section under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

Figure 6:
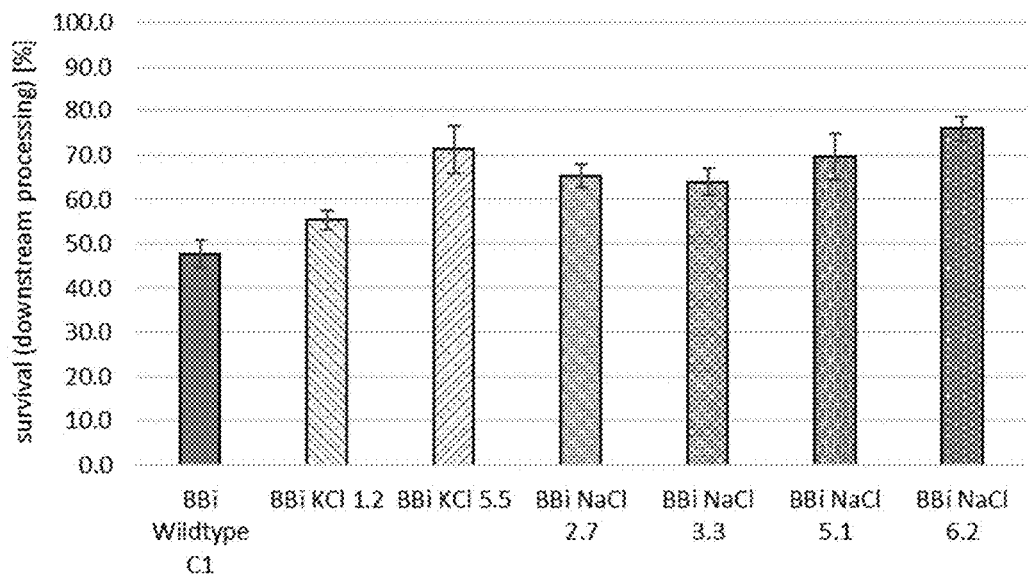
FIG. 6 is a graph showing the survival of cells after downstream processing in percent of cells from cultures BBi Wildtype C1 (solid dark grey), BBi KCl 1.2 (diagonal stripes downward), BBi KCl 5.5 (diagonal stripes upward), BBi NaCl 2.7 (50% dotted), BBi NaCl 3.3 (60% dotted), BBi NaCl 5.1 (70% dotted) and BBi NaCl 6.2 (80% dotted) as compared to fermentation cell numbers after conditioning (CN).

As shown in FIG. 6 strains BBi KCl 1.2, BBi KCl 5.5, BBi NaCl 2.7, BBi NaCl 3.3, BBi NaCl 5.1 and BBi NaCl 6.2 showed higher stability in downstream processing than BBi Wildtype C1.

Example 10

Storage Stability of Strains BBi KCl 1.2, BBi KCl 5.5, BBi NaCl 2.7, BBi NaCl 3.3, BBi NaCl 5.1 and BBi NaCl 6.2

Sample material generated in Example 9 was stored at 40% relative humidity and 30° C. following the protocol described under "Storage stability testing in 96-well "small-scale" plate assay at 30° C. and 40% relative humidity" in the general method section. Subsequently the material was tested for its CFU content after storage at 30° C. and 40% relative humidity for either 14 d (CFU (storage, 30 C, wet, 14 d)) or 28 d (CFU (storage, 30 C, wet, 28 d)), applying the methods described for cell survival, plating and statistical processing in the general method section. Survival (storage, 30 C, wet, X) for respective storage time X was calculated according to $$\text{survival(storage, 30}C\text{, wet, } X) = \frac{CFU(\text{storage, 30}C\text{, wet, } X)}{CFU(T0)}$$

It was found that strains BBi KCl 1.2, BBi KCl 5.5, BBi NaCl 2.7 and BBi NaCl 6.2 had significant improved survival, i.e. significantly improved storage stability as compared to BBi Wildtype C1, if stored at 30° C. and 40% relative humidity for either 14 d or 28 d. Strains BBi NaCl 3.3 and BBi NaCl 5.1 showed improved survival after 14 d, but not 28 d storage (FIG. 7.)

Sample material generated in example 9 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for either 7 d (CFU (storage, 50 C, dry, 7 d)) or 14 d (CFU (storage, 50 C, dry, 14 d)), applying the methods described for cell survival, plating and statistical processing in the general method section. Survival (storage, 50 C, dry, X) for respective storage time X was calculated according to $$\text{survival(storage, 50}C\text{, dry, } X) = \frac{CFU(\text{storage, 50}C\text{, dry, } X)}{CFU(T0)}$$

It was found that strains BBi KCl 1.2, BBi NaCl 2.7, BBi NaCl 3.3, BBi NaCl 5.1 and BBi NaCl 6.2 had improved survival, i.e. improved storage stability as compared to BBi Wildtype C1, if stored at 50° C. and low relative humidity for either 7 d or 14 d. Strain BBi KCl 5.5 showed improved storage stability after 7 d, but not anymore after 14 d of storage (data not shown).

Example 11

Effective Productivity of BBi KCl 1.2, BBi KCl 5.5, BBi NaCl 2.7, BBi NaCl 3.3, BBi NaCl 5.1 and BBi NaCl 6.2 for Different Storage Conditions From cultivating the strains as described in Example 8 processing the strains as described in Example 9 and analyzing the strains as described in Example 10 the information was gained to derive the effective productivity of the strains according to:

$$P_{eff} = \frac{\Delta\ CFU}{\Delta\ t_{fermentation}}$$

In the present example, for $\Delta CFU$ the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for either 14 d or 28 d at 30° C. and 40% relative humidity, strains BBi KCl 1.2, BBi KCl 5.5, BBi NaCl 2.7, BBi NaCl 3.3, BBi NaCl 5.1 and BBi NaCl 6.2 exhibited higher effective productivity than BBi Wildtype C1 (FIG. 8).

The effective productivity determination was carried out with the strains cultivated as described in Example 8 processed as described in Example 9 and stored for either 7 d or 14 d at 50° C. at low relative humidity as described in Example 10 It was found that strains BBi KCl 1.2, BBi KCl 5.5, BBi NaCl 2.7, BBi NaCl 3.3, BBi NaCl 5.1 and BBi NaCl 6.2 exhibited higher effective productivity than BBi Wildtype C1, (data not shown).

Example 12

Performance of Strains BBi Heat 4.1 and BBi Heat 6.6 Heat

Seed cultures of BBi Wildtype C1, BBi Heat 4.1 and BBi Heat 6.6 were generated following the three-step seed culture protocol as described in the "general method" section. Of the second stage seed cultures, 7 mL were inoculated into 343 mL of BBi medium (Table 2). One vessel each was inoculated with BBi Wildtype C1, BBi Heat 4.1 and BBi Heat 6.6, respectively. The cumulative addition of base (Table 1) was recorded. Time courses of the cumulative base addition in the three fermentation runs are shown in FIG. 9.

BBi Wildtype C1 was harvested after 18.25 h, BBi Heat 4.1 after 18.95 h and BBi Heat 6.6 after 19.10 h. Final cell dry weight concentrations at harvest demonstrated a reduction in concentration for both heat evolved strains where cell concentrations were on the order of 4.8 g/l and 5 g/l for strains BBi Heat 4.1 and BBi Heat 6.6 respectively while the concentrations for BBi Wildtype C1 were on the order of 5.7 g/l. Alterations in harvest time may explain this negative result.

Cultures of BBi Wildtype C1, BBi Heat 4.1 and BBi Heat 6.6 were harvested into 500 mL shake flasks, capped and stored for 1 h in a 10 C water bath. Cell concentrations determined after storage demonstrated a similar decrease for heat evolved strains where concentrations were on the order of $8 \times 10^{10}$ and $1 \times 10^{10}$ CFU/mL for BBi Heat 4.1 and BBi Heat 6.6 respectively whereas the BBi Wildtype C1 demonstrated on the order of $1.55 \times 10^{10}$ CFU/ml.

Example 13

Performance of BBi Heat 4.1 and BBi Heat 6.6 Heat in Downstream Processing

Sample material generated in Example 12 was processed following the protocol described in the general method section under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

As strains BBi Heat 4.1 and BBi Heat 6.6 showed higher stability in downstream processing than BBi Wildtype C1, where BBi Heat 4.1 and BBi Heat 6.6 showed on the order of 82% and 75% survival respectively, whereas BBi Wildtype C1 demonstrated on the order of 68% survival.

Example 14

Storage Stability of BBi Heat 4.1 and BBi Heat 6.6 Heat

Sample material generated in Example 13 was stored at 40% relative humidity and 30° C. following the protocol described under "Storage stability testing in 96-well "small-scale" plate assay at 30° C. and 40% relative humidity" in the general method section. Subsequently the material was tested for its CFU content after storage at 30° C. and 40% relative humidity ("wet") for 14 d (CFU (30 C, wet, 14 d)), applying the methods described for cell survival, plating and statistical processing in the general method section. Survival (storage, 30 C, wet, 14 d) was calculated according to $$\text{survival(downstream processing)} = \frac{CFU(30C, \text{wet}, 14d)}{CFU(T0)}$$

It was found that the strains BBi Heat 4.1 and BBi Heat 6.6 had significant improved survival, i.e. significantly improved storage stability, as compared to BBi Wildtype C1, if stored at 30° C. and 40% relative humidity for 14 d, where BBi Heat 4.1 and BBi Heat 6.6 had on the order of 32% and 47% survival respectively whereas the BBi Wildtype C1 demonstrated only about 10% survival.

Sample material generated in Example 13 was stored at low relative humidity and 30° C. following the protocol described under "Storage stability testing in 96-well "small-scale" plate assay at 30° C. and low relative humidity" in the general method section. Subsequently the material was tested for its CFU content after storage at 30° C. and low relative humidity for 137 d (CFU (30 C, dry, 137 d)), applying the methods described for cell survival, plating and statistical processing in the general method section. Survival (storage, 30 C, dry, 137 d) was calculated according to $$\text{survival(downstream processing)} = \frac{CFU(30C, \text{dry}, 137d)}{CFU(T0)}$$

It was found that the strains BBi Heat 4.1 and BBi Heat 6.6 had significant improved survival, i.e. significantly improved storage stability, as compared to BBi Wildtype C1, if stored at 30° C. and low relative humidity for 137 d, where the data correlated well with the data for the 30 C, wet, 14 d assay described above.

Sample material generated in example 13 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for 14 d (CFU (50 C, dry, 14 d)), applying the methods described for cell survival, plating and statistical processing in the general method section. Survival (storage, 50 C, dry, 14 d) was calculated according to $$\text{survival(downstream processing)} = \frac{CFU(50C, \text{dry}, 14d)}{CFU(T0)}$$

It was found that strains BBi Heat 4.1 had significant improved survival, i.e. significantly improved storage stability, as compared to BBi Wildtype C1, if stored at 50° C. and low relative humidity for 14 d, however the BBi Heat 6.6 strain did not demonstrate an improvement opposite the BBi Wildtype C1, showing on the order of a 50% reduction in survival.

Example 15

Effective Productivity of BBi Heat 4.1 and BBi Heat 6.6 Heat for Different Storage Conditions From cultivating the strains as described in Example 12 processing the strains as described in Example 13, and analyzing the strains as described in Example 14 the information was gained to derive the effective productivity of the strains according to:

$$P_{\it eff} = \frac{\Delta\, CFU}{\Delta\, t_{fermentation}}$$

In the present example, for ΔCFU the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for 14 d at 30° C. and 40% relative humidity, strains BBi Heat 4.1 and BBi Heat 6.6 exhibited significantly higher effective productivity than BBi Wildtype C1 (FIG. 10).

The effective productivity determination was carried out with the strains cultivated as described in Example 12, processed as described in Example 13 and stored at 137 d at 30° C. and low relative humidity as described in Example 14. It was found that strains BBi Heat 4.1 and BBi Heat 6.6 exhibited significantly higher effective productivity than BBi Wildtype C1.

The effective productivity determination was carried out with the strains cultivated as described in EXAMPLE, processed as described in Example 13 and stored at 14 d at 50° C. and low relative humidity as described in Example 14. It was found that strains BBi Heat 4.1 exhibited significantly higher effective productivity than BBi Wildtype C1 (FIG. 11)

Example 16

Performance of Strains BBi KCl 1.2, BBi NaCl 2.7, BBi NaCl 3.3, BBi NaCl 5.1 and BBi NaCl 6.2

Seed cultures of BBi Wildtype C1, BBi KCl 1.2, BBi NaCl 2.7, BBi NaCl 3.3, BBi NaCl 5.1 and BBi NaCl 6.2 were generated following the three-step seed culture protocol as described in the "general method" section. Of the second stage seed cultures, 7 mL were inoculated into 343 mL of BBi medium (Table 2). One vessel each was inoculated with BBi Wildtype C1, BBi KCl 1.2, BBi NaCl 2.7, BBi NaCl 3.3, BBi NaCl 5.1 and BBi NaCl 6.2, respectively. The cumulative addition of base (Table 1) was recorded. Time courses of the cumulative base addition in the three fermentation runs are shown in FIG. 12.

BBi Wildtype C1 was harvested after 18.25 h, BBi KCl 1.2 after 15.45 h, BBi NaCl 2.7 after 15.45 h, BBi NaCl 3.3 after 18.25 h, BBi NaCl 5.1 after 15.35 h and BBi NaCl 6.2 after 15.35 h, respectively. Final cell dry weight concentrations at harvest are shown in FIG. 13.

Cultures of BBi Wildtype C1, BBi KCl 1.2, BBi NaCl 2.7, BBi NaCl 3.3, BBi NaCl 5.1 and BBi NaCl 6.2 were harvested into 500 mL shake flasks, capped and stored for 1 h in a 10 C water bath. Cell concentrations determined after storage are shown in FIG. 14.

Example 17

Performance of BBi KCl 1.2, BBi NaCl 2.7, BBi NaCl 3.3, BBi NaCl 5.1 and BBi NaCl 6.2 in Downstream Processing Sample material generated in Example 16 was processed following the protocol described in the general method section under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

As shown in FIG. 15 strains BBi KCl 1.2, BBi NaCl 2.7, BBi NaCl 5.1 and BBi NaCl 6.2 showed higher stability in downstream processing than BBi Wildtype C1.

Example 18

Storage Stability of BBi KCl 1.2, BBi NaCl 2.7, BBi NaCl 3.3, BBi NaCl 5.1 and BBi NaCl 6.2

Sample material from Example 17 was stored at 40% relative humidity and 30° C. following the protocol described under "Storage stability testing in 96-well "small-scale" plate assay at 30° C. and 40% relative humidity" in the general method section. Subsequently the material was tested for its CFU content after storage at 30° C. and 40% relative humidity ("wet") for 14 d (CFU (30 C, wet, 14 d)), applying the methods described for cell survival, plating and statistical processing in the general method section. Survival (storage, 30 C, wet, 14 d) was calculated according to $$\text{survival(storage, } 30C, \text{wet, } 14\, d) = \frac{CFU(30C, \text{wet}, 14d)}{CFU(T0)}$$

It was found that the strains BBi Heat 4.1 and BBi Heat 6.6 had significant improved survival, i.e. significantly improved storage stability, as compared to BBi Wildtype C1, if stored at 30° C. and 40% relative humidity for 14 d (FIG. 16).

Sample material generated in Example 17 was stored at low relative humidity and 30° C. following the protocol described under "Storage stability testing in 96-well "small-scale" plate assay at 30° C. and low relative humidity" in the general method section. Subsequently the material was tested for its CFU content after storage at 30° C. and low relative humidity for 137 d (CFU (30 C, dry, 137 d)), applying the methods described for cell survival, plating and statistical processing in the general method section. Survival (storage, 30 C, dry, 137 d) was calculated according to $$\text{survival(storage, } 30C, \text{ dry, } 137d) = \frac{CFU(30C, \text{ dry, } 137d)}{CFU(T0)}$$

It was found that the strains BBi KCl 1.2, BBi NaCl 3.3, BBi NaCl 5.1 and BBi NaCl 6.2 had improved survival, i.e. improved storage stability, as compared to BBi Wildtype C1, if stored at 30° C. and low relative humidity for 137 d (FIG. 17).

Sample material generated in example 17 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for 14 d (CFU (50 C, dry, 14 d)), applying the methods described for cell survival, plating and statistical processing in the general method section. Survival (storage, 50 C, dry, 14 d) was calculated according to $$\text{survival(storage, } 50C, \text{ dry, } 14d) = \frac{CFU(50C, \text{ dry, } 14d)}{CFU(T0)}$$

It was found that none of the strains had significant improved survival, i.e. significantly improved storage stability, as compared to BBi Wildtype C1, if stored at 50° C. and low relative humidity for 14 d (FIG. 18).

Example 19

Effective Productivity of BBi KCl 1.2, BBi NaCl 2.7, BBi NaCl 3.3, BBi NaCl 5.1 and BBi NaCl 6.2

From cultivating the strains as described in Example 16, processing the strains as described in example 17, and analyzing the strains after storage as described in example 18, the information was gained to derive the effective productivity of the strains according to:

$$P_{eff} = \frac{\Delta\ CFU}{\Delta\ t_{fermentation}}$$

In the present example, for ΔCFU the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for 14 d at 30° C. and 40% relative humidity, strains BBi NaCl 2.7, BBi NaCl 3.3 and BBi NaCl 6.2 exhibited significantly higher effective productivity than BBi Wildtype C1 (FIG. 19).

The effective productivity determination was carried out with the strains cultivated as described in Example 16, processed as described in Example 17 and stored at 137 d at 30° C. and low relative humidity as described in Example 18. It was found that strains BBi KCl 1.2, BBi NaCl 3.3, BBi NaCl 5.1 and BBi NaCl 6.2 exhibited significantly higher effective productivity than BBi Wildtype C1 (FIG. 20).

The effective productivity determination was carried out with the strains cultivated as described in example 16, processed as described in example 17, and stored at 14 d at 50° C. and low relative humidity as described in Example 18 It was found that none of the strains exhibited significantly higher effective productivity than BBi Wildtype C1 (FIG. 21).

Example 20

Genetic Changes in the Heat-Evolved and Salt Evolved BBi Clones

Applicants sequenced the two heat-evolved clones, and six salt evolved clones that were tested in the accelerated assays (BBi Heat 4.1, BBi Heat 6.6, BBi KCl 1.2, BBi, KCl 5.5, BBi NaCl 2.7, BBi NaCl 3.3, BBi NaCl 5.1 and BBi NaCl 6.2) using whole genome sequencing and aligned the reads to the reference sequence for of the ancestral BBi clone (NC_017867) using breseq (see general methods for details). To determine what mutations evolved over the course of the selection experiments, Applicants also sequenced the ancestral strain to identify discrepancies between the reference sequence and the ancestral strain. For any further analyses, only mutations that were present in the evolved clones but not in the ancestor were considered. It was assumed that mutations that occurred in the ancestral strains were most likely sequencing errors in the reference sequences or differences between our ancestral strain and the reference strains that was sequenced initially. Because the clones were isolated from different populations and as such had independent evolutionary histories, mutations that evolved in more than one strain were of particular interest, especially when genes acquired different mutations in different strains. Such parallel evolution is often indicative of beneficial or selective mutations.

The heat-evolved clones with improved storage stability, BBi Heat 4.1 and BBi Heat 6.6, acquired 12 and 13 mutations, respectively (Table 6, Table 7). Seven of these mutations occurred in both independently evolved strains. Two genes, the polyribonucleotide nucleotidyltransferase (EC 2.7.7.8) and the response regulator consisting of a CheY-like receiver domain and a winged-helix DNA-binding domain, acquired mutations at different sites within the genes and are therefore of particular interest, because it suggests that mutations could be due to convergent evolution and these genes could be targets of selection. Some of the mutations in these heat evolved strains were additionally found in salt evolved BBi strains, indicating greater significance.

TABLE 6

Mutations in the heat-evolved strains Heat 4.1

| Description | Position | Change | Annotation |
|---|---|---|---|
| Polyribonucleotide nucleotidyltransferase (EC 2.7.7.8) | 401,119 | C→T | H369Y (CAT→TAT) |
| SSU ribosomal protein S5p (S2e) | 477,512* | C→T | T139T (ACC→ACT) |
| Phosphoglycerate mutase (EC 5.4.2.1)/Oleate hydratase (EC 4.2.1.53) | 530,981* | C→A | intergenic (+352/−296) |
| Pup ligase PafA' paralog, possible component of postulated heterodimer PafA-PafA' | 753,989 | T→C | A407A (GCT→GCC) |
| Response regulators consisting of a CheY-like receiver domain and a winged-helix DNA-binding domain | 775,035 | A→G | D148G (GAT→GGT) |
| UTP--glucose-1-phosphate uridylyltransferase (EC 2.7.7.9) | 937,068 | A→G | A14A (GCT→GCC) |
| Arginine/ornithine antiporter ArcD | 1,480,689* | C→T | V228V (GTG→GTA) |
| Lipid A export ATP-binding/permease protein MsbA | 1,495,900 | A→G | S189P (TCC→CCC) |
| narrowly conserved hypothetical protein | 1,599,890 | A→G | S307P (TCC→CCC) |
| Pyridoxine biosynthesis glutamine amidotransferase, glutaminase subunit (EC 2.4.2.—) | 1,639,044* | T→C | H89H (CAT→CAC) |
| Homoserine dehydrogenase (EC 1.1.1.3)/Diaminopimelate decarboxylase (EC 4.1.1.20) | 1,663,472 | T→G | intergenic (−19/+254) |
| hypothetical protein | 1,799,246 | G→A | S75S (AGC→AGT) |

*Mutation additionally found in salt evolved strains

TABLE 7

Mutations in Heat 6.6

| Description | Position | Change | Annotation |
|---|---|---|---|
| Sucrose operon repressor ScrR, LacI family | 153,322 | C→T | M287I (ATG→ATA) |
| Transcriptional regulator, ArsR family/Uncharacterized NAD(FAD)-dependent dehydrogenase | 291,701* | (G)₁₂→₁₅ | intergenic (+864/+49) |
| Polyribonucleotide nucleotidyltransferase (EC 2.7.7.8) | 401,824 | G→A | G604S (GGC→AGC) |
| SSU ribosomal protein S5p (S2e) | 477,512* | C→T | T139T (ACC→ACT) |
| Phosphoglycerate mutase (EC 5.4.2.1)/Oleate hydratase (EC 4.2.1.53) | 530,981* | C→A | intergenic (+352/−296) |
| Substrate-specific component YkoE of thiamin-regulated ECF transporter for HydroxyMethylPyrimidine | 600,836 | G→A | G32D (GGC→GAC) |
| Pup ligase PafA' paralog, possible component of postulated heterodimer PafA-PafA' | 753,989 | T→C | A407A (GCT→GCC) |
| Response regulators consisting of a CheY-like receiver domain and a winged-helix DNA-binding domain | 775,307 | C→T | R239C (CGT→TGT) |
| UTP--glucose-1-phosphate uridylyltransferase (EC 2.7.7.9) | 937,068 | A→G | A14A (GCT→GCC) |
| Exodeoxyribonuclease III (EC 3.1.11.2) | 1,318,370 | T→C | G100G (GGA→GGG) |
| Arginine/ornithine antiporter ArcD | 1,480,689* | C→T | V228V (GTG→GTA) |
| Pyridoxine biosynthesis glutamine amidotransferase, glutaminase subunit (EC 2.4.2.—) | 1,639,044* | T→C | H89H (CAT→CAC) |
| putative phosphoglycerate mutase family protein | 1,859,179 | G→T | R113S (CGT→AGT) |

*Mutation additionally found in salt evolved strains.

Mutations in PNPase or the response regulators consisting of a CheY-like receiver domain and a winged-helix DNA-binding domain also occur in other clones of the same population, although not all the clones from one population had the same mutation. It is reasonable to conclude that mutations in these genes are of benefit for adaptation to the selective conditions.

Two KCl-evolved and four NaCl-evolved clones were sequenced as described in the General Methods. Eight mutations occurred in all the six clones. The two KCl-evolved clones shared five mutations, one in an intergenic region between two hypothetical genes, one SNP to a stop codon in a hydrolase and two non-synonymous SNPs in a hypothetical gene and a substitution in the response regulators consisting of a CheY-like receiver domain and a winged-helix DNA-binding. While both KCl-evolved strains shared the same R175L mutation in the response regulators consisting of a CheY-like receiver domain and a winged-helix DNA-binding, it was different from the two mutations in this gene observed in the heat-evolved clones.

The NaCl-evolved clones did not acquire any mutations in this gene. Among the four NaCl-evolved clones, it was observed that 16 mutations occurred in all four clones. Five of them were synonymous SNPs, and one mutations was in an intergenic region between a putative amidotransferase and a hypothetical gene. Four mutations were unique to NaCl 2.7 and NaCl 6.2. One of them was a synonymous change in large transmembrane protein possibly involved in transport, another mutation was in an intergenic region between a uridylyltransferase and a transcriptional regulator of the ArsR family. A deletion in a hypothetical gene likely caused a frameshift. A V58M mutation evolved in TrkA, a potassium uptake protein in both improved, NaCl-evolved clones independently.

Mutations found in BBi KCl 1.2, BBi KCl 5.5, BBi NaCl 2.7, BBi NaCl 3.3, BBi NaCl 5.1 and BBi NaCl 6.2 are found in Tables 8-13 respectively. Mutations common to all KCL evolved BBi strains are found in Table 14, Mutations common to all NaCl evolved strains are found in Table 15. Mutations common to all salt evolved BBi strains are found in Table 16.

TABLE 8

Mutations in BBi KCl_1.2

| Description | Position | Change | Annotation |
|---|---|---|---|
| hypothetical protein/hypothetical protein | 239,643 | A→G | intergenic (−232/+218) |
| FIG00672191: hypothetical protein | 438,495 | G→A | G473S (GGT→AGT) |
| SSU ribosomal protein S5p (S2e) | 477,512 | C→T | T139T (ACC→ACT) |
| Phosphoglucomutase (EC 5.4.2.2) | 503,076 | C→T | C325C (TGC→TGT) |
| Phosphoglycerate mutase (EC 5.4.2.1)/Oleate hydratase (EC 4.2.1.53) | 530,981 | C→A | intergenic (+352/−296) |
| FIG00671939: hypothetical protein | 583,508 | C→T | P140L (CCC→CTC) |
| Pantothenate kinase type III, CoaX-like (EC 2.7.1.33) | 660,753 | G→A | A187A (GCC→GCT) |
| Response regulators consisting of a CheY-like receiver domain and a winged-helix DNA-binding domain | 775,116 | G→T | R175L (CGT→CTT) |
| Argininosuccinate synthase (EC 6.3.4.5) | 857,663 | C→T | S370S (TCC→TCT) |
| tRNA-Asn-GTT/FIG00424337: hypothetical protein | 895,939 | G→A | intergenic (+18/−91) |
| FIG00424359: hypothetical protein | 1,033,071 | G→A | A25V (GCC→GTC) |
| Hydrolases of the alpha/beta superfamily | 1,036,193 | C→A | C239* (TGC→TGA) |
| Lipase | 1,203,768 | G→A | A159T (GCT→ACT) |
| Putative glucose uptake permease | 1,259,521 | G→A | T303I (ACA→ATA) |
| Octaprenyl diphosphate synthase (EC 2.5.1.90)/Dimethylallyltransferase (EC 2.5.1.1)/(2E,6E)-farnesyl diphosphate synthase (EC 2.5.1.10)/Geranylgeranyl pyrophosphate synthetase (EC 2.5.1.29) | 1,274,555 | T→A | L144Q (CTG→CAG) |
| Arginine/ornithine antiporter ArcD | 1,480,689 | C→T | V228V (GTG→GTA) |
| Pyridoxine biosynthesis glutamine amidotransferase, glutaminase subunit (EC 2.4.2.—) | 1,639,044 | T→C | H89H (CAT→CAC) |
| Inosine-uridine preferring nucleoside hydrolase (EC 3.2.2.1)/tRNA-Met-CAT | 1,688,482 | G→A | intergenic (−252/−18) |

TABLE 9

Mutations found in BBi NaCl_2.7

| Description | Position | Change | Annotation |
|---|---|---|---|
| Chromosomal replication initiator protein DnaA | 1,580 | G→A | D483N (GAC→AAC) |
| Aldo/keto reductase of diketogulonate reductase family(EC: 1.1.1.274) | 47,291 | C→T | R71C (CGT→TGT) |
| Nucleoside-diphosphate-sugar epimerases | 135,554 | C→T | A170T (GCC→ACC) |
| Fructose-bisphosphate aldolase class II (EC 4.1.2.13) | 142,555 | G→A | G20S (GGC→AGC) |

TABLE 9-continued

Mutations found in BBi NaCl_2.7

| Description | Position | Change | Annotation |
|---|---|---|---|
| hypothetical protein | 160,543 | G→A | R66Q (CGA→CAA) |
| large transmembrane protein possibly involved in transport | 185,139 | C→T | L136L (CTG→TTG) |
| putative ABC transporter integral membrane protein | 190,165 | T→C | T485A (ACA→GCA) |
| Ammonium transporter | 222,035 | G→A | V74V (GTG→GTA) |
| Nitrogen regulatory protein P-II/[Protein-PII] uridylyltransferase (EC 2.7.7.59) | 223,714 | Δ1 bp | intergenic (+265/−46) |
| [Protein-PII] uridylyltransferase (EC 2.7.7.59)/Transcriptional regulator, ArsR family | 225,656 | G→T | intergenic (+70/−291) |
| Putative amidotransferase similar to cobyric acid synthase/hypothetical protein | 230,092 | T→A | intergenic (+12/−96) |
| hypothetical protein | 322,863 | C→T | T2083T (ACC→ACT) |
| KH domain RNA binding protein YlqC | 327,730 | A→G | I33I (ATT→ATC) |
| Acetolactate synthase large subunit (EC 2.2.1.6) | 343,510 | G→A | T549I (ACC→ATC) |
| Regulator of polyketide synthase expression | 381,032 | T→C | F79S (TTC→TCC) |
| SSU ribosomal protein S5p (S2e) | 477,512 | C→T | T139T (ACC→ACT) |
| Seryl-tRNA synthetase (EC 6.1.1.11) | 500,089 | G→A | I175I (ATC→ATT) |
| Seryl-tRNA synthetase (EC 6.1.1.11) | 500,143 | C→T | K157K (AAG→AAA) |
| Phosphoglucomutase (EC 5.4.2.2) | 503,076 | C→T | C325C (TGC→TGT) |
| Phosphoglycerate mutase (EC 5.4.2.1)/Oleate hydratase (EC 4.2.1.53) | 530,981 | C→A | intergenic (+352/−296) |
| Lactose and galactose permease, GPH translocator family/Beta-galactosidase (EC 3.2.1.23) | 566,713 | G→A | intergenic (−62/−248) |
| ABC-type multidrug transport system, ATPase component/putative integral membrane transport protein | 587,079 | C→T | intergenic (+31/−92) |
| ABC transporter ATP-binding protein | 596,883 | T→C | H553R (CAC→CGC) |
| Pantothenate kinase type III, CoaX-like (EC 2.7.1.33) | 660,753 | G→A | A187A (GCC→GCT) |
| Putative esterase family | 701,111 | T→C | D287G (GAC→GGC) |
| Signal transduction histidine kinase | 776,580 | G→A | A414T (GCA→ACA) |
| ABC-type amino acid transport system, permease component | 792,815 | C→T | L37L (CTC→CTT) |
| DNA ligase (EC 6.5.1.2) | 823,806 | C→T | H513Y (CAT→TAT) |
| Argininosuccinate synthase (EC 6.3.4.5) | 857,663 | C→T | S370S (TCC→TCT) |
| Trk system potassium uptake protein TrkA | 867,940 | G→A | V58M (GTG→ATG) |
| Ribose-phosphate pyrophosphokinase (EC 2.7.6.1) | 877,516 | A→C | Q334P (CAG→CCG) |
| tRNA-Asn-GTT/FIG00424337: hypothetical protein | 895,939 | G→A | intergenic (+18/−91) |
| Putative glucose uptake permease | 1,259,521 | G→A | T303I (ACA→ATA) |
| hypothetical protein | 1,408,991 | G→A | V330M (GTG→ATG) |
| Histidinol-phosphate aminotransferase (EC 2.6.1.9) | 1,412,476 | C→T | G352R (GGG→AGG) |
| FIG00424197: hypothetical protein | 1,430,776 | G→A | V94V (GTG→GTA) |
| Arginine/ornithine antiporter ArcD | 1,480,689 | C→T | V228V (GTG→GTA) |
| DNA-directed RNA polymerase beta subunit (EC 2.7.7.6) | 1,575,622 | G→A | T261T (ACC→ACT) |
| hypothetical protein | 1,612,670 | G→T | P249P (CCC→CCA) |
| Pyridoxine biosynthesis glutamine amidotransferase, glutaminase subunit (EC 2.4.2.—) | 1,639,044 | T→C | H89H (CAT→CAC) |
| CpsF | 1,641,256 | C→T | P31L (CCG→CTG) |
| Arginyl-tRNA synthetase (EC 6.1.1.19) | 1,667,054 | C→T | A85T (GCC→ACC) |
| hypothetical protein | 1,759,804 | (C)₅→₄ | coding (64/144 nt) |
| hypothetical protein | 1,797,815 | G→T | I552I (ATC→ATA) |

TABLE 10

Mutations found in BBi NaCl_3.3

| Description | Position | Change | Annotation |
|---|---|---|---|
| Phosphoenolpyruvate carboxylase (EC 4.1.1.31) | 75,773 | C→A | A415S (GCC→TCC) |

TABLE 10-continued

Mutations found in BBi NaCl_3.3

| Description | Position | Change | Annotation |
|---|---|---|---|
| Fructose-bisphosphate aldolase class II (EC 4.1.2.13) | 142,555 | G→A | G20S (GGC→AGC) |
| hypothetical protein | 160,543 | G→A | R66Q (CGA→CAA) |
| putative ABC transporter integral membrane protein | 190,165 | T→C | T485A (ACA→GCA) |
| Putative amidotransferase similar to cobyric acid synthase/hypothetical protein | 230,092 | T→A | intergenic (+12/−96) |
| DNA topoisomerase I (EC 5.99.1.2) | 261,490 | T→C | Y402H (TAC→CAC) |
| KH domain RNA binding protein YlqC | 327,730 | A→G | I33I (ATT→ATC) |
| Aspartate aminotransferase (EC 2.6.1.1) | 377,615 | C→T | A386V (GCG→GTG) |
| Regulator of polyketide synthase expression | 381,032 | T→C | F79S (TTC→TCC) |
| SSU ribosomal protein S5p (S2e) | 477,512 | C→T | T139T (ACC→ACT) |
| Phosphoglucomutase (EC 5.4.2.2) | 503,076 | C→T | C325C (TGC→TGT) |
| Phosphoglycerate mutase (EC 5.4.2.1)/Oleate hydratase (EC 4.2.1.53) | 530,981 | C→A | intergenic (+352/−296) |
| putative integral membrane transport protein | 588,716 | G→C | G516R (GGC→CGC) |
| ABC transporter ATP-binding protein | 596,883 | T→C | H553R (CAC→CGC) |
| Pantothenate kinase type III, CoaX-like (EC 2.7.1.33) | 660,753 | G→A | A187A (GCC→GCT) |
| Putative esterase family | 701,111 | T→C | D287G (GAC→GGC) |
| DNA polymerase IV (EC 2.7.7.7) | 706,887 | C→A | L165L (CTC→CTA) |
| Signal transduction histidine kinase | 776,580 | G→A | A414T (GCA→ACA) |
| FIG00672362: hypothetical protein | 778,758 | C→T | S346S (TCC→TCT) |
| ABC-type amino acid transport system, permease component | 792,815 | C→T | L37L (CTC→CTT) |
| UDP-galactose-lipid carrier transferase (EC 2.—.—.—) | 794,606 | G→A | R233H (CGT→CAT) |
| DNA ligase (EC 6.5.1.2) | 823,806 | C→T | H513Y (CAT→TAT) |
| Argininosuccinate synthase (EC 6.3.4.5) | 857,663 | C→T | S370S (TCC→TCT) |
| Ribose-phosphate pyrophosphokinase (EC 2.7.6.1) | 876,529 | T→A | L5H (CTC→CAC) |
| tRNA-Asn-GTT/FIG00424337: hypothetical protein | 895,939 | G→A | intergenic (+18/−91) |
| Glutamate synthase [NADPH] large chain (EC 1.4.1.13) | 1,024,702 | G→A | H1229Y (CAC→TAC) |
| CarD-like transcriptional regulator | 1,136,466 | C→T | V68V (GTG→GTA) |
| Putative glucose uptake permease | 1,259,521 | G→A | T303I (ACA→ATA) |
| UDP-N-acetylmuramoylalanyl-D-glutamate--2,6-diaminopimelate ligase (EC 6.3.2.13) | 1,387,346 | C→A | A206S (GCC→TCC) |
| hypothetical protein | 1,408,213 | Δ1 bp | coding (210/1404 nt) |
| Histidinol-phosphate aminotransferase (EC 2.6.1.9) | 1,412,476 | C→T | G352R (GGG→AGG) |
| Arginine/ornithine antiporter ArcD | 1,480,689 | C→T | V228V (GTG→GTA) |
| Exodeoxyribonuclease VII large subunit (EC 3.1.11.6) | 1,525,663 | C→T | A31V (GCG→GTG) |
| DNA-directed RNA polymerase beta subunit (EC 2.7.7.6) | 1,575,622 | G→A | T261T (ACC→ACT) |
| Dihydroorotate dehydrogenase (EC 1.3.3.1) | 1,587,929 | C→A | L275L (CTC→CTA) |
| narrowly conserved hypothetical protein | 1,594,660 | G→A | P76L (CCG→CTG) |
| hypothetical protein | 1,612,670 | G→T | P249P (CCC→CCA) |
| Pyridoxine biosynthesis glutamine amidotransferase, glutaminase subunit (EC 2.4.2.—) | 1,639,044 | T→C | H89H (CAT→CAC) |
| Arginyl-tRNA synthetase (EC 6.1.1.19) | 1,667,054 | C→T | A85T (GCC→ACC) |
| hypothetical protein | 1,797,815 | G→T | I552I (ATC→ATA) |

TABLE 11

Mutations found in BBi NaCl_5.1

| Description | Position | Change | Annotation |
|---|---|---|---|
| membrane protein, putative | 12,475 | C→A | F295L (TTC→TTA) |
| Glycoside-Pentoside-Hexuronide (GPH): Cation symporter family protein | 58,459 | (C)$_{7\to6}$ | coding (684/1260 nt) |
| Cell division protein FtsI [Peptidoglycan synthetase] (EC 2.4.1.129) | 98,500 | C→T | A11A (GCG→GCA) |
| Serine/threonine phosphatase PPP (EC 3.1.3.16) | 100,438 | C→T | V462V (GTG→GTA) |

TABLE 11-continued

Mutations found in BBi NaCl_5.1

| Description | Position | Change | Annotation |
|---|---|---|---|
| probable LysR-type transcriptional regulator | 140,558 | C→T | N139N (AAC→AAT) |
| Fructose-bisphosphate aldolase class II (EC 4.1.2.13) | 142,555 | G→A | G20S (GGC→AGC) |
| hypothetical protein | 160,543 | G→A | R66Q (CGA→CAA) |
| putative ABC transporter integral membrane protein | 190,165 | T→C | T485A (ACA→GCA) |
| Putative amidotransferase similar to cobyric acid synthase/hypothetical protein | 230,092 | T→A | intergenic (+12/−96) |
| AAA+ superfamily protein | 272,037 | C→T | S227F (TCC→TTC) |
| KH domain RNA binding protein YlqC | 327,730 | A→G | I33I (ATT→ATC) |
| LSU ribosomal protein L19p | 360,979 | G→A | G54S (GGC→AGC) |
| Regulator of polyketide synthase expression | 381,032 | T→C | F79S (TTC→TCC) |
| SSU ribosomal protein S5p (S2e) | 477,512 | C→T | T139T (ACC→ACT) |
| Phosphoglucomutase (EC 5.4.2.2) | 503,076 | C→T | C325C (TGC→TGT) |
| Phosphoglycerate mutase (EC 5.4.2.1)/Oleate hydratase (EC 4.2.1.53) | 530,981 | C→A | intergenic (+352/−296) |
| ABC transporter ATP-binding protein | 596,883 | T→C | H553R (CAC→CGC) |
| Pantothenate kinase type III, CoaX-like (EC 2.7.1.33) | 660,753 | G→A | A187A (GCC→GCT) |
| Putative esterase family | 701,111 | T→C | D287G (GAC→GGC) |
| Translation elongation factor Tu | 731,021 | C→T | N279N (AAC→AAT) |
| Signal transduction histidine kinase | 776,580 | G→A | A414T (GCA→ACA) |
| ABC-type amino acid transport system, permease component | 792,815 | C→T | L37L (CTC→CTT) |
| DNA ligase (EC 6.5.1.2) | 823,806 | C→T | H513Y (CAT→TAT) |
| Argininosuccinate synthase (EC 6.3.4.5) | 857,663 | C→T | S370S (TCC→TCT) |
| Ribose-phosphate pyrophosphokinase (EC 2.7.6.1) | 877,503 | G→T | E330* (GAA→TAA) |
| Phosphoglycerate mutase family | 882,410 | G→A | K52K (AAG→AAA) |
| tRNA-Asn-GTT/FIG00424337: hypothetical protein | 895,939 | G→A | intergenic (+18/−91) |
| Aquaporin Z | 941,074 | G→T | E163D (GAG→GAT) |
| Putative glucose uptake permease | 1,259,521 | G→A | T303I (ACA→ATA) |
| Ribosomal subunit interface protein | 1,283,740 | G→A | H101H (CAC→CAT) |
| Histidinol-phosphate aminotransferase (EC 2.6.1.9) | 1,412,476 | C→T | G352R (GGG→AGG) |
| Arginine/ornithine antiporter ArcD | 1,480,689 | C→T | V228V (GTG→GTA) |
| CRISPR-associated RecB family exonuclease Cas4/CRISPR-associated protein Cas1/Similar to Glutamate-cysteine ligase (EC 6.3.2.2) | 1,512,712 | Δ74 bp | intergenic (−1071/+684) |
| DNA-directed RNA polymerase beta subunit (EC 2.7.7.6) | 1,575,622 | G→A | T261T (ACC→ACT) |
| hypothetical protein | 1,612,670 | G→T | P249P (CCC→CCA) |
| Pyridoxine biosynthesis glutamine amidotransferase, glutaminase subunit (EC 2.4.2.—) | 1,639,044 | T→C | H89H (CAT→CAC) |
| Arginyl-tRNA synthetase (EC 6.1.1.19) | 1,667,054 | C→T | A85T (GCC→ACC) |
| Phosphoglycerol transferase and related proteins, alkaline phosphatase superfamily | 1,776,580 | C→A | L163M (CTG→ATG) |
| hypothetical protein | 1,797,815 | G→T | I552I (ATC→ATA) |

TABLE 12

Mutations found in BBi NaCl_6.2

| Description | Position | Change | Annotation |
|---|---|---|---|
| Fructose-bisphosphate aldolase class II (EC 4.1.2.13) | 142,555 | G→A | G20S (GGC→AGC) |
| hypothetical protein | 160,543 | G→A | R66Q (CGA→CAA) |
| large transmembrane protein possibly involved in transport | 185,139 | C→T | L136L (CTG→TTG) |
| putative ABC transporter integral membrane protein | 190,165 | T→C | T485A (ACA→GCA) |
| [Protein-PII] uridylyltransferase (EC 2.7.7.59)/Transcriptional regulator, ArsR family | 225,656 | G→T | intergenic (+70/−291) |
| Putative amidotransferase similar to cobyric acid synthase/hypothetical protein | 230,092 | T→A | intergenic (+12/−96) |
| DNA topoisomerase I (EC 5.99.1.2) | 261,725 | C→A | P480Q (CCG→CAG) |

TABLE 12-continued

Mutations found in BBi NaCl_6.2

| Description | Position | Change | Annotation |
|---|---|---|---|
| DNA topoisomerase I (EC 5.99.1.2) | 262,579 | G→A | E765K (GAG→AAG) |
| Transcriptional regulator, ArsR family/Uncharacterized NAD(FAD)-dependent dehydrogenase | 291,701 | (G)₁₂→₁₄ | intergenic (+864/+49) |
| KH domain RNA binding protein YlqC | 327,730 | A→G | I33I (ATT→ATC) |
| Regulator of polyketide synthase expression | 381,032 | T→C | F79S (TTC→TCC) |
| SSU ribosomal protein S5p (S2e) | 477,512 | C→T | T139T (ACC→ACT) |
| Phosphoglycerate mutase (EC 5.4.2.1)/Oleate hydratase (EC 4.2.1.53) | 530,981 | C→A | intergenic (+352/−296) |
| ABC transporter ATP-binding protein | 596,883 | T→C | H553R (CAC→CGC) |
| Pantothenate kinase type III, CoaX-like (EC 2.7.1.33) | 660,753 | G→A | A187A (GCC→GCT) |
| Putative esterase family | 701,111 | T→C | D287G (GAC→GGC) |
| Pup ligase PafA, possible component of postulated heterodimer PafA-PafA' | 755,738 | C→T | Q17* (CAG→TAG) |
| Signal transduction histidine kinase | 776,580 | G→A | A414T (GCA→ACA) |
| ABC-type amino acid transport system, permease component | 792,815 | C→T | L37L (CTC→CTT) |
| DNA ligase (EC 6.5.1.2) | 823,806 | C→T | H513Y (CAT→TAT) |
| Argininosuccinate synthase (EC 6.3.4.5) | 857,663 | C→T | S370S (TCC→TCT) |
| Trk system potassium uptake protein TrkA | 867,940 | G→A | V58M (GTG→ATG) |
| tRNA-Asn-GTT/FIG00424337: hypothetical protein | 895,939 | G→A | intergenic (+18/−91) |
| hypothetical protein | 1,088,447 | C→A | G178W (GGG→TGG) |
| Putative glucose uptake permease | 1,259,521 | G→A | T303I (ACA→ATA) |
| Putative glucose uptake permease | 1,260,264 | C→A | G55G (GGG→GGT) |
| Histidinol-phosphate aminotransferase (EC 2.6.1.9) | 1,412,476 | C→T | G352R (GGG→AGG) |
| Arginine/ornithine antiporter ArcD | 1,480,689 | C→T | V228V (GTG→GTA) |
| DNA-directed RNA polymerase beta subunit (EC 2.7.7.6) | 1,575,622 | G→A | T261T (ACC→ACT) |
| hypothetical protein | 1,612,670 | G→T | P249P (CCC→CCA) |
| Pyridoxine biosynthesis glutamine amidotransferase, glutaminase subunit (EC 2.4.2.—) | 1,639,044 | T→C | H89H (CAT→CAC) |
| Arginyl-tRNA synthetase (EC 6.1.1.19) | 1,667,054 | C→T | A85T (GCC→ACC) |
| hypothetical protein | 1,759,804 | (C)₅→₁₄ | coding (64/144 nt) |
| hypothetical protein | 1,797,815 | G→T | I552I (ATC→ATA) |

TABLE 13

Mutations found in BBi KCL5.5

| Description | Position | Change | Annotation |
|---|---|---|---|
| hypothetical protein/hypothetical protein | 239,643 | A→G | intergenic (−232/+218) |
| ABC transporter, permease protein | 280,330 | T→C | S255P (TCC→CCC) |
| Transcriptional regulator, ArsR family/Uncharacterized NAD(FAD)-dependent dehydrogenase | 291,701 | (G)₁₂→₁₄ | intergenic (+864/+49) |
| Signal recognition particle, subunit Ffh SRP54 (TC 3.A.5.1.1) | 335,845 | C→A | H304N (CAC→AAC) |
| SSU ribosomal protein S5p (S2e) | 477,512 | C→T | T139T (ACC→ACT) |
| SSU ribosomal protein S13p (S18e) | 481,620 | T→G | Y21D (TAT→GAT) |
| Phosphoglucomutase (EC 5.4.2.2) | 503,076 | C→T | C325C (TGC→TGT) |
| Phosphoglycerate mutase (EC 5.4.2.1)/Oleate hydratase (EC 4.2.1.53) | 530,981 | C→A | intergenic (+352/−290) |
| Pantothenate kinase type III, CoaX-like (EC 2.7.1.33) | 660,753 | G→A | A187A (GCC→GCT) |
| Histone acetyltransferase HPA2 and related acetyltransferases | 688,078 | A→G | T133A (ACA→GCA) |
| Response regulators consisting of a CheY-like receiver domain and a winged-helix DNA-binding domain | 775,116 | G→T | R175L (CGT→CTT) |
| Argininosuccinate synthase (EC 6.3.4.5) | 857,663 | C→T | S370S (TCC→TCT) |
| tRNA-Asn-GTT/FIG00424337: hypothetical protein | 895,939 | G→A | intergenic (+18/−91) |
| Phosphoglycolate phosphatase (EC 3.1.3.18) | 929,879 | G→A | N52N (AAC→AAT) |
| FIG00424359: hypothetical protein | 1,033,071 | G→A | A25V (GCC→GTC) |
| Hydrolases of the alpha/beta superfamily | 1,036,193 | C→A | C239* (TGC→TGA) |

TABLE 13-continued

Mutations found in BBi KCL5.5

| Description | Position | Change | Annotation |
|---|---|---|---|
| Cysteine desulfurase (EC 2.8.1.7), SufS subfamily | 1,052,457 | C→T | E271E (GAG→GAA) |
| Putative glucose uptake permease | 1,259,521 | G→A | T303I (ACA→ATA) |
| Arginine/ornithine antiporter ArcD | 1,480,689 | C→T | V228V (GTG→GTA) |
| CRISPR-associated RecB family exonuclease Cas4/CRISPR-associated protein Cas1/Similar to Glutamate-cysteine ligase (EC 6.3.2.2) | 1,512,570 | Δ72 bp | intergenic (−929/+828) |
| Ribonucleotide reductase of class III (anaerobic), activating protein (EC 1.97.1.4)/Ribonucleotide reductase of class III (anaerobic), large subunit (EC 1.17.4.2) | 1,522,462 | T→C | intergenic (−15/+327) |
| Phosphoglucosamine mutase (EC 5.4.2.10) | 1,535,726 | C→T | S240S (TCG→TCA) |
| Pyridoxine biosynthesis glutamine amidotransferase, glutaminase subunit (EC 2.4.2.—) | 1,639,044 | T→C | H89H (CAT→CAC) |

TABLE 14

Mutations common to all NaCl Evolved BBi strains

| Description | Position | Change | Annotation |
|---|---|---|---|
| Fructose-bisphosphate aldolase class II (EC 4.1.2.13) | 142,555 | G→A | G20S (GGC→AGC) |
| hypothetical protein | 160,543 | G→A | R66Q (CGA→CAA) |
| putative ABC transporter integral membrane protein | 190,165 | T→C | T485A (ACA→GCA) |
| KH domain RNA binding protein YlqC | 327,730 | A→G | I33I (ATT→ATC) |
| Regulator of polyketide synthase expression | 381,032 | T→C | F79S (TTC→TCC) |
| ABC transporter ATP-binding protein | 596,883 | T→C | H553R (CAC→CGC) |
| Putative esterase family | 701,111 | T→C | D287G (GAC→GGC) |
| Signal transduction histidine kinase | 776,580 | G→A | A414T (GCA→ACA) |
| ABC-type amino acid transport system, permease component | 792,815 | C→T | L37L (CTC→CTT) |
| Histidinol-phosphate aminotransferase (EC 2.6.1.9) | 1,412,476 | C→T | G352R (GGG→AGG) |
| DNA-directed RNA polymerase beta subunit (EC 2.7.7.6) | 1,575,622 | G→A | T261T (ACC→ACT) |
| hypothetical protein | 1,612,670 | G→T | P249P (CCC→CCA) |
| Arginyl-tRNA synthetase (EC 6.1.1.19) | 1,667,054 | C→T | A85T (GCC→ACC) |
| hypothetical protein | 1,797,815 | G→T | I552I (ATC→ATA) |

TABLE 15

Mutations common to all KCL evolved BBi strains

| Description | Position | Change | Annotation |
|---|---|---|---|
| hypothetical protein/hypothetical protein | 239,643 | A→G | intergenic (−232/+218) |
| Response regulators consisting of a CheY-like receiver domain and a winged-helix DNA-binding domain | 775,116 | G→T | R175L (CGT→CTT) |
| FIG00424359: hypothetical protein | 1,033,071 | G→A | A25V (GCC→GTC) |
| Hydrolases of the alpha/beta superfamily | 1,036,193 | C→A | C239* (TGC→TGA) |

TABLE 16

Mutations common to all salt evolved BBi strains.

| Description | Position | Change | Annotation |
|---|---|---|---|
| SSU ribosomal protein S5p (S2e) | 477,512 | C→T | T139T (ACC→AC$\underline{\text{T}}$) |
| Phosphoglycerate mutase (EC 5.4.2.1)/Oleate hydratase (EC 4.2.1.53) | 530,981 | C→A | intergenic (+352/−296) |
| Phosphoglycerate mutase type III, CoaX-like (EC 2.7.1.33) | 660,753 | G→A | A187A (GC$\underline{\text{C}}$→GC$\underline{\text{T}}$) |
| Argininosuccinate synthase (EC 6.3.4.5) | 857,663 | C→T | S370S (TCC→TC$\underline{\text{T}}$) |
| tRNA-Asn-GTT/FIG00424337: hypothetical protein | 895,939 | G→A | intergenic (+18/−91) |
| Putative glucose uptake permease | 1,259,521 | G→A | T303I (AC$\underline{\text{A}}$→A$\underline{\text{T}}$A) |
| Arginine/ornithine antiporter ArcD | 1,480,689 | C→T | V228V (G$\underline{\text{T}}$G→G$\underline{\text{T}}$A) |
| Pyridoxine biosynthesis glutamine amidotransferase, glutaminase subunit (EC 2.4.2.—) | 1,639,044 | T→C | H89H (CA$\underline{\text{T}}$→CA$\underline{\text{C}}$) |

Example 21

Testing the Stability of Evolved Mutations in BBi Heat 4.1 and BBi Heat 6.6, During Fermentation To test whether the new mutations were stably maintained in a clonal populations during fermentation and production, Applicants sequenced end of run populations from small scale fermentations AA029 and checked for polymorphism of these new mutations in the populations. Such polymorphism would be indicative of new mutations or revertant mutations arising during the fermentation process. Because the process began with clonal populations, it was expected that all evolved mutations would occur at a frequency of 1 (100%) in a population. If a mutation was not stable, would it be expected that the frequency would be smaller than 1.

Six populations from EOR fermentations were sequenced and the populations were analyzed as polymorphic populations in breseq (Deatherage and Barrick 2014) using the polymorphism option (-p). This analysis confirmed that the mutations found in EOR sample from a fermentation run with this clone and all mutations occurred at a frequency of 100% in the population, suggesting that no reversion mutations evolved at a measurable frequency.

Example 22

Evolution and Selection of *Lactobacillus acidophilus* NCFM

The experimental evolution and identification of improved clones were done as indicated in the general methods. Briefly, eight single colonies were isolated by streaking the frozen *L. acidophilus* NCFM stock MRS agar. These colonies were grown up in MRS agar and subsequently used to start eight replicated populations that were selected in different selective environments. A sample of these cultures were supplemented with 20% glycerol and frozen at −80° C.

The eight parallel populations were started by inoculating 7 mL MRS supplemented with cysteine in 24-well plates at a starting OD of 0.2, covered with the adhesive aluminum foil and incubated at 42° C. and 100 rpm for 24 hours. The populations were transferred to fresh media on a daily basis with a few exceptions when they were transferred after up to 48 hours of incubation. At transfer, 7 mL MRS with cysteine were inoculated with the cultures at an OD of 0.2. The number of generations per transfers were calculated following (Lenski et al. 1991) as:

$$\text{Number of generations} = \frac{\log\left(\frac{\text{Final } OD}{\text{Initial } OD}\right)}{\log 2}$$

The populations were transferred daily as described above. After 6 days, the temperature was raised to 44° C. for the remained of the selection experiment. At least once a week, we supplemented a sample of each population with glycerol (20% final concentration) and froze it at −80° C. All selections were run for about 100 generations. At the end of the experiment, a sample of each population was supplemented with 20% glycerol and frozen at −80° C. for further analysis.

To assess storage stability of the heat-evolved clones, five single colonies were isolated as described in the general methods. These single clones were then grown under benign conditions at 37° C. and 100 rpm for 24 hours under anaerobic conditions. The cultures were transferred to 3.5 mL MRS supplemented with cysteine at an OD of 0.2 in two new 48 deep-well plates and incubated overnight at 37° C. and 100 rpm. At the same time, each clonal culture was supplemented with glycerol stocks for a final concentration of 20% glycerol and froze them at −80° C. After incubation, 1 mL of the cultures at OD=4 was spun down, supernatant removed, and stabilizer added before the pellets were flash frozen and freeze dried for 24 hours in the lyophilizer as described in the general methods section. After 24 hours freeze drying the pellets were stored at 30° C. and 40% humidity and the viability of the clones was assessed at regular intervals: right after lyophilization, 96, 196 and 290 hours of storage. The cultures were resuspended in MRS broth supplemented with cysteine, serially diluted 10-fold and 5 μl of the dilutions were spotted on MRS agar plates. The majority of the populations had clones with improved storage stability when compared to the ancestor. Two clones from independently evolved populations, NCFM Heat 1.1 and NCFM Heat 6.3, were chosen for further investigation.

Example 23

Performance of Strains NCFM Heat 1.1 and NCFM Heat 6.3

Seed cultures of NCFM Wildtype C1, NCFM Wildtype C2, NCFM Heat 1.1 and NCFM Heat 6.3 were generated following the three-step seed culture protocol as described in the "general method" section. Of the second stage seed cultures, 7 mL were inoculated into 343 mL of NCFM medium (Table 2). One vessel each was inoculated with NCFM Wildtype C1, NCFM Wildtype C2, NCFM Heat 1.1 and NCFM Heat 6.3, respectively. The cumulative addition of base (Table 1) was recorded. Time courses of the cumulative base addition in the four fermentation runs are shown in (FIG. 22.)

NCFM Wildtype C1 was harvested after 13.63 h, NCFM Wildtype C2 after 14.73 h, NCFM Heat 1.1 after 14.73 h and NCFM Heat 6.3 after 14.73 h. Final cell dry weight concentrations at harvest are shown in FIG. 23. Cultures of NCFM Wildtype C1, NCFM Wildtype C2, NCFM Heat 1.1 and NCFM Heat 6.3 were harvested into 500 mL shake flasks, capped and stored for 1 h in a 10 C water bath. Cell concentrations determined after storage are shown in FIG. 24

Example 24

Performance of Strains NCFM Heat 1.1 and NCFM Heat 6.3 in Downstream Processing

Sample material generated in Example 23 was processed following the protocol described in the general method section under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

As shown in FIG. 25 both evolved strains, NCFM Heat 1.1 and NCFM Heat 6.3, showed higher stability in downstream processing than the two wildtype control cultures, NCFM Wildtype C1 and NCFM Wildtype C2.

Example 25

Storage Stability of Strains NCFM Heat 1.1 and NCFM Heat 6.3

Sample material generated in Example 24 was stored at 40% relative humidity and 30° C. following the protocol described under "Storage stability testing in 96-well "small-scale" plate assay at 30° C. and 40% relative humidity" in the general method section. Subsequently the material was tested for its CFU content after storage at 30° C. and 40% relative humidity for either X=14 d (CFU (storage, 30 C, wet, 14 d)) or X=28 d (CFU (storage, 30 C, wet, 28 d)), applying the methods described for cell survival, plating and statistical processing in the general method section. Survival (storage, 30 C, wet, X) for respective storage time X was calculated according to $$\text{survival(storage, 30}C\text{, wet, }X\text{)} = \frac{CFU(\text{storage, 30}C\text{, wet, }X)}{CFU(T0)}$$

It was found that both strains, NCFM Heat 1.1 and NCFM Heat 6.3, had significant improved survival, i.e. significantly improved storage stability as compared to the two control cultures, NCFM Wildtype C1 and NCFM Wildtype C1, if stored at 30° C. and 40% relative humidity for either 14 d or 28 d (FIG. 26).

Sample material generated in Example 24 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for either X=7 d (CFU (storage, 50 C, dry, 7 d)) or X=14 d (CFU (storage, 50 C, dry, 14 d)), applying the methods described for cell survival, plating and statistical processing in the general method section. Survival (storage, 50 C, dry, X) for respective storage time X was calculated according to $$\text{survival(storage, 50}C\text{, dry, }X\text{)} = \frac{CFU(\text{storage, 50}C\text{, dry, }X)}{CFU(T0)}$$

It was found that strain NCFM Heat 1.1 had significant improved survival, i.e. significantly improved storage stability, if stored at 50° C. and low relative humidity for either 7 d or 14 d, as compared to both control strain, NCFM Wildtype C1 and NCFM Wildtype C2. However, strain NCFM Heat 6.3 only exhibited improved storage stability as compared to the control culture NCFM Wildtype C2, but less storage stability than the NCFM Wildtype C1 culture, if stored at 50° C. and low relative humidity for either 7 d or 14 d FIG. 27.

Example 26

Effective Productivity of NCFM Heat 1.1 Heat and NCFM Heat 6.3 for Different Storage Conditions From cultivating the strains as described in Example 23, processing the strains as described in Example 24, and analyzing the strains as described in Example 25 the information was gained to derive the effective productivity of the strains according to:

$$P_{eff} = \frac{\Delta\ CFU}{\Delta\ t_{fermentation}}$$

In the present example, for ΔCFU the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for either 14 d or 28 d at 30° C. and 40% relative humidity, both evolved strains, NCFM Heat 1.1 and NCFM Heat 6.3, exhibited significantly higher effective productivity than both control strains, NCFM Wildtype C1 and NCFM Wildtype C2 (FIG. 28).

The effective productivity determination was carried out with the strains cultivated as described in Example 23 processed as described in Example 24 and stored for either 7 d or 14 d at 50° C. at low relative humidity as described in Example 25 It was found that strain NCFM Heat 1.1 exhibited higher effective productivity than both control strains, NCFM Wildtype C1 and NCFM Wildtype C2, if stored for either 7 d or 14 d. However, NCFM Heat 6.3 exhibited only higher effective productivity than control cultures NCFM Wildtype C2, but lower than NCFM Wildtype C1, if stored for either 7 d or 14 d (FIG. 29).

Example 27

Performance of Strains NCFM Heat 1.1 and NCFM Heat 6.3

Seed cultures of NCFM Wildtype C1, NCFM Wildtype C2, NCFM Heat 1.1 and NCFM Heat 6.3 were generated following the three-step seed culture protocol as described in the "general method" section. Of the second stage seed cultures, 7 mL were inoculated into 343 mL of NCFM medium (Table 2). One vessel each was inoculated with NCFM Wildtype C1, NCFM Wildtype C2, NCFM Heat 1.1 and NCFM Heat 6.3, respectively. The cumulative addition of base (Table 1) was recorded. Time courses of the cumulative base addition in the four fermentation runs are shown in FIG. 30

NCFM Wildtype C1 was harvested after 10.98 h, NCFM Wildtype C2 after 11.60 h, NCFM Heat 1.1 after 12.20 h and NCFM Heat 6.3 after 12.80 h. Final cell dry weight concentrations at harvest are shown in FIG. 31. Cultures of NCFM Wildtype C1, NCFM Wildtype C2, NCFM Heat 1.1 and NCFM Heat 6.3 were harvested into 500 mL shake flasks, capped and stored for 1 h in a 10 C water bath. Cell concentrations determined after storage are shown in FIG. 32.

Example 28

Performance of strains NCFM Heat 1.1 and NCFM Heat 6.3 in Downstream Processing Sample material generated in Example 27 was processed following the protocol described in the general method section under "downstream processing in 96-well "small-scale" plate assay". Along the processing steps, cell numbers were determined as described in the general method section after the conditioning step as "CN", and as a second time as "T0" after their downstream processing. Survival (downstream processing) was subsequently calculated according to $$\text{survival(downstream processing)} = \frac{CFU(T0)}{CFU(CN)}$$

As shown in FIG. 33 both evolved strains, NCFM Heat 1.1 and NCFM Heat 6.3, showed higher stability in downstream processing than the two wildtype control cultures, NCFM Wildtype C1 and NCFM Wildtype C2.

Example 29

Storage Stability of Strains NCFM Heat 1.1 and NCFM Heat 6.3

Sample material generated in Example 28 was stored at 40% relative humidity and 30° C. following the protocol described under "Storage stability testing in 96-well "small-scale" plate assay at 30° C. and 40% relative humidity" in the general method section. Subsequently the material was tested for its CFU content after storage at 30° C. and 40% relative humidity for 28 d (CFU (storage, 30° C., wet, 28 d)), applying the methods described for cell survival, plating and statistical processing in the general method section. Survival (storage, 30° C., wet, 28 d) was calculated according to $$\text{survival(storage, 30}C\text{, wet, 28}d) = \frac{CFU(\text{storage, 30}C\text{, wet, 28}d)}{CFU(T0)}$$

It was found that strains NCFM Heat 6.3 had improved survival, i.e. improved storage stability as compared to the two control cultures, NCFM Wildtype C1 and NCFM Wildtype C1, if stored at 30° C. and 40% relative humidity for 28 d (FIG. 34).

Sample material generated in Example 28 was stored at low relative humidity and 30° C. following the protocol described under "Storage stability testing in 96-well "small-scale" plate assay at 30° C. and low relative humidity" in the general method section. Subsequently the material was tested for its CFU content after storage at 30° C. and low relative humidity for 4 m (CFU (storage, 30 C, dry, 4 m)), applying the methods described for cell survival, plating and statistical processing in the general method section. Survival (storage, 30 C, dry, 4 m) for respective storage time X was calculated according to $$\text{survival(storage, 30}C\text{, dry, 4}m) = \frac{CFU(\text{storage, 30}C\text{, dry, 4}m)}{CFU(T0)}$$

Results are provided in FIG. 35.

Sample material generated in Example 28 was stored at low relative humidity and 50° C. following the protocol described under "Storage stability testing in 96-well "small-scale" plate assay at 50° C. and low relative humidity" in the general method section. Subsequently the material was tested for its CFU content after storage at 50° C. and low relative humidity for 14 d (CFU (storage, 50 C, dry, 14 d)), applying the methods described for cell survival, plating and statistical processing in the general method section. Survival (storage, 50 C, dry, 14 d) was calculated according to $$\text{survival(storage, 50}C\text{, dry, 14}d) = \frac{CFU(\text{storage, 50}C\text{, dry, 14})}{CFU(T0)}$$

Results are provided in FIG. 36.

Example 30

Effective Productivity of NCFM Heat 1.1 Heat and NCFM Heat 6.3 for Different Storage Conditions From cultivating the strains as described in Example 27, processing the strains as described in Example 28, and analyzing the strains as described in Example 29 the information was gained to derive the effective productivity of the strains according to:

$$P_{eff} = \frac{\Delta\ CFU}{\Delta\ t_{fermentation}}$$

In the present example, for ΔCFU the surviving "equivalent" cell concentrations for the strains in the last stage fermentations were taken. The cells provided in the inoculum in this example were considered neglectable and consequently the "equivalent" cell concentrations for the strains were not corrected. For $\Delta t_{fermentation}$ only the fermentation time for the strains in the last stage vessel was considered. It was found that after downstream processing and storage of the cultures for either 14 d or 28 d at 30° C. and 40% relative humidity, strain NCFM Heat 6.3 exhibited higher effective productivity than both control strains, NCFM Wildtype C1 and NCFM Wildtype C2 (FIG. 37).

The effective productivity determination was carried out with the strains cultivated as described in Example 27, processed as described in Example 28 and stored for either 4 m at 30° C. at low relative humidity as described in Example 29. Results are provided in FIG. 38.

The effective productivity determination was carried out with the strains cultivated as described in Example 27, processed as described in Example 28 and stored for 14 d at 50° C. and low relative humidity as described in Example 29. Results are provided in FIG. 39.

Example 31

Genetic Differences in Heat Evolved *Lactobacillus acidophilus* NCFM

Whole genome sequencing was performed on all selected clones essentially as described in the General Methods. The genomes of the two heat-evolved clones were sequenced and analyzed using breseq (Deatherage and Barrick 2014) as described in the general methods. In addition, the unevolved ancestor was also sequenced. Only mutations that did not occur in the ancestor were considered. One of the clones, NCFM Heat 6.3 had 9 mutations (Table 17), 7 of them were shared by NCFM Heat 1.1. With the exception of one intergenic mutation, all mutations in NCFM Heat 1.1 (Table 18) were in coding sequences and likely have an effect on the function of the gene. One mutation in gntR resulted in a early stop codon, likely affecting the function of the gene. In addition, two other mutations in a cation transporter and a transposon were deletions of one nucleotide that likely resulted in a frameshift and in affected the function of the genes. The additional two mutations in NCFM Heat 6.3 were a synonymous mutation in rpsU and non-synonymous substitution in theronly-tRNA synthetase.

TABLE 17

Mutations in NCFM Heat 1.1

| Description | Position | Change | Annotation | Gene |
|---|---|---|---|---|
| 30S ribosomal protein S18 | 9,960 | C→T | R47C (CGT→TGT) | rpsR |
| cation transporter | 98,615 | (A)₈→₇ | coding (71/1107 nt) | LBA0098 |
| transposase | 121,570 | Δ1 bp | coding (1210/1242 nt) | LBA0127 |
| ATPase | 277,061 | C→A | A232D (GCT→GAT) | clpC |
| pyridoxal kinase | 985,309 | G→T | D194Y (GAT→TAT) | LBA1007 |
| transcriptional regulator | 1,166,676 | C→A | E14* (GAA→TAA) | gntR |
| uridine mono phosphate kinase/elongation factor Ts | 1,247,879 | (T)₆→₄ | intergenic (-93/+77) | LBA1268/tsf |

TABLE 18

Mutations in NCFM Heat 6.3

| Description | Position | Change | Annotation | Gene |
|---|---|---|---|---|
| 30S ribosomal protein S18 | 9,960 | C→T | R47C (CGT→TGT) | rpsR |
| cation transporter | 98,615 | (A)₈→₇ | coding (71/1107 nt) | LBA0098 |
| transposase | 121,570 | Δ1 bp | coding (1210/1242 nt) | LBA0127 |
| ATPase | 277,061 | C→A | A232D (GCT→GAT) | clpC |
| pyridoxal kinase | 985,309 | G→T | D194Y (GAT→TAT) | LBA1007 |
| transcriptional regulator | 1,166,676 | C→A | E14* (GAA→TAA) | gntR |
| 30S ribosomal protein S21 | 1,181,343 | A→C | L16L (CTT→CTG) | rpsU |
| uridine mono phosphate kinase/elongation factor Ts | 1,247,879 | (T)₆→₄ | intergenic (-93/+77) | LBA1268/tsf |
| theronyl-tRNA synthetase | 1,531,825 | C→T | D634N (GAT→AAT) | thrS |

REFERENCES

The following references, to the extent that they provide exemplary procedural or other details supplementary to those set forth herein, are specifically incorporated herein by reference.

Brenner D M, Chey W D. 2009. *Bifidobacterium infantis* 35624: a novel probiotic for the treatment of irritable bowel syndrome. Rev Gastroenterol Disord 9:7-15.

Briczinski E P, Loquasto J R, Barrangou R, Dudley E G, Roberts A M, Roberts R F. 2009. Strain-specific genotyping of *Bifidobacterium animalis* subsp. *lactis* by using single-nucleotide polymorphisms, insertions, and deletions. Appl Environ Microbiol 75:7501-7508.

Broadbent J R, Neeno-Eckwall E C, Stahl B, Tandee K, Cai H, Morovic W, Horvath P, Heidenreich J, Perna N T, Barrangou R, et al. 2012. Analysis of the *Lactobacillus casei* supragenome and its influence in species evolution and lifestyle adaptation. BMC Genomics 13:533.

Brock T D. 1989. Biotechnology: A Textbook of Industrial Microbiology. Sunderland, M A: Sinauer Associates, Inc.

Castro H P, Teixeira P M, Kirby R. 1997. Evidence of membrane damage in *Lactobacillus bulgaricus* following freeze drying. Journal of Applied Microbiology 82:87-94.

Chouraqui J P, Van Egroo L D, Fichot M C. 2004. Acidified milk formula supplemented with *Bifidobacterium lactis*: impact on infant diarrhea in residential care settings. J Pediatr Gastroenterol Nutr 38:288-292.

de Vrese M, Winkler P, Rautenberg P, Harder T, Noah C, Laue C, Ott S, Hampe J, Schreiber S, Heller K, et al. 2005. Effect of *Lactobacillus gasseri* PA 16/8, *Bifidobacterium longum* SP 07/3, *B. bifidum* MF 20/5 on common cold episodes: a double blind, randomized, controlled trial. Clin Nutr 24:481-491.

Deatherage D E, Traverse C C, Wolf L N, Barrick J E. 2014. Detecting rare structural variation in evolving microbial populations from new sequence junctions using breseq. Front Genet 5:468.

Gerhardt. P, Murray R G E, Castilow R N, Nester E W, Wood W A, Krieg N R, Phillips G B. 1994. Manual of Methods for General Bacteriology In. Washington, DC: American Society for Microbiology.

Hale W G, Margham J P. 1991. Harper Collins Dictionary of Biology: Harper Perennial, New York.

Izu H, Adachi O, Yamada M. 1997. Gene organization and transcriptional regulation of the gntRKU operon involved in gluconate uptake and catabolism of *Escherichia coli*. J Mol Biol 267:778-793.

Kim J Y, Kwon J H, Ahn S H, Lee S I, Han Y S, Choi Y O, Lee S Y, Ahn K M, Ji G E. 2010. Effect of probiotic mix (*Bifidobacterium bifidum, Bifidobacterium lactis, Lactobacillus acidophilus*) in the primary prevention of eczema: a double-blind, randomized, placebo-controlled trial. Pediatr Allergy Immunol 21:e386-393.

Kulkarni S, Haq S F, Samant S, Sukumaran S. 2017. Adaptation of *Lactobacillus acidophilus* to Thermal Stress Yields a Thermotolerant Variant Which Also Exhibits Improved Survival at pH 2. Probiotics Antimicrob Proteins.

Lenski R E, Rose M R, Simpson S C, Tadler S C. 1991. Long-Term Experimental Evolution in *Escherichia coli*. I. Adaptation and Divergence During 2,000 Generations. American Naturalist 138:1315-1341.

Li C, Li P Z, Sun J W, Huo G C, Liu L B. 2014. Proteomic analysis of the response to NaCl stress of *Lactobacillus bulgaricus*. Biotechnol Lett 36:2263-2269.

Lilly D M, Stillwell R H. 1965. Probiotics: Growth-Promoting Factors Produced by Microorganisms. Science 147: 747-748.

a) Liu K, Zeng X, Qiao L, Li X, Yang Y, Dai C, Hou A, Xu D. 2014. The sensitivity and significance analysis of parameters in the model of pH regulation on lactic acid production by *Lactobacillus bulgaricus*. BMC Bioinformatics 15 Suppl 13:S5.

b) Liu X T, Hou C L, Zhang J, Zeng X F, Qiao S Y. 2014. Fermentation conditions influence the fatty acid composition of the membranes of *Lactobacillus reuteri* 15007 and its survival following freeze-drying. Lett Appl Microbiol 59:398-403.

Louesdon S, Charlot-Rouge S, Tourdot-Marechal R, Bouix M, Beal C. 2015. Membrane fatty acid composition and fluidity are involved in the resistance to freezing of *Lactobacillus buchneri* R1102 and *Bifidobacterium longum* R0175. Microb Biotechnol 8:311-318.

Macfarlane S, Steed H, Macfarlane G T. 2009. Intestinal bacteria and inflammatory bowel disease. Crit Rev Clin Lab Sci 46:25-54.

Matto J, Malinen E, Suihko M L, Alander M, Palva A, Saarela M. 2004. Genetic heterogeneity and functional properties of intestinal bifidobacteria. J Appl Microbiol 97:459-470.

Mills S, Stanton C, Fitzgerald G F, Ross R P. 2011. Enhancing the stress responses of probiotics for a lifestyle from gut to product and back again. Microb Cell Fact 10 Suppl 1:S19.

Morovic W, Roper J M, Smith A B, Mukerji P, Stahl B, Rae J C, Ouwehand A C. 2017. Safety evaluation of HOW-ARU® Restore (*Lactobacillus acidophilus* NCFM, *Lactobacillus paracasei* Lpc-37, *Bifidobacterium animalis* subsp. *lactis* Bl-04 and *B. lactis* Bi-07) for antibiotic resistance, genomic risk factors, and acute toxicity. Food Chem Toxicol 110:316-324.

Mueller S, Saunier K, Hanisch C, Norin E, Alm L, Midtvedt T, Cresci A, Silvi S, Orpianesi C, Verdenelli M C, et al. 2006. Differences in fecal microbiota in different European study populations in relation to age, gender, and country: a cross-sectional study. Appl Environ Microbiol 72:1027-1033.

Prasad J, McJarrow P, Gopal P. 2003. Heat and Osmotic Stress Responses of Probiotic *Lactobacillus rhamnosus* HN001 (DR20) in Relation to Viability after Drying. Applied and Environmental Microbiology 69:917-925.

Sanders M E, Klaenhammer T R. 2001. Invited review: the scientific basis of *Lactobacillus acidophilus* NCFM functionality as a probiotic. J Dairy Sci 84:319-331.

Saxer G, Krepps M D, Merkley E D, Ansong C, Deatherage Kaiser B L, Valovska M T, Ristic N, Yeh P T, Prakash V P, Leiser O P, et al. 2014. Mutations in global regulators lead to metabolic selection during adaptation to complex environments. PLoS Genet 10:e1004872.

Simpson P J, Stanton C, Fitzgerald G F, Ross R P. 2005. Intrinsic tolerance of *Bifidobacterium* species to heat and oxygen and survival following spray drying and storage. J Appl Microbiol 99:493-501.

Singleton P, Sainsbury D. 2006. Dictionary of Microbiology and Molecular Biology. Chichester, New York, Weinheim, Brisbane, Singapore, Toronto: John Wiley & Sons, Ltd.

Stahl B, Barrangou R. 2012. Complete genome sequences of probiotic strains *Bifidobacterium animalis* subsp. *lactis* B420 and Bi-07. J Bacteriol 194:4131-4132.

Tsunedomi R, Izu H, Kawai T, Yamada M. 2003. Dual control by regulators, GntH and GntR, of the Gntll genes for gluconate metabolism in *Escherichia coli*. J Mol Microbiol Biotechnol 6:41-56.

Upadrasta A, Stanton C, Hill C, Fitzgerald G F, Ross P R. 2011. Improving the Stress Tolerance of Probiotic Cultures: Recent Trends and Future Directions. In: Tsakalidou E, Papadimitriou K, editors. Stress Responses of Lactic Acid Bacteria. New York: Springer. p. 395-438.

Yoo J, Tcheurekdjian H, Lynch S V, Cabana M, Boushey H A. 2007. Microbial manipulation of immune function for asthma prevention: inferences from clinical trials. Proc Am Thorac Soc 4:277-282.

SEQUENCE LISTING (5 sequences)

SEQ ID NO: 1 - DNA, 1938822 bp, Bifidobacterium animalis
tatccacatcggaacctgttgcgggagcaaaaacccagtgttttcaacacgcaagcctgtggataacttctgctcgatggagtaagaatagtatgttatctatatctgactccaagaatgggtgaagtgctcgatgaacgcagagaatctcgaccccgccacgcaggcgcagaccatttggtccgacacgcttgcgttgatcaagcagaactccagactcaccgcgcgcgaacagggctggctcgccggggtcactgccgaggcggtggtcggcaccacgatcattctcgatgtggagaacgcgcagacattgcaggtattgcagaccgaactcaacgagccgatcataggcgcgctggagatcgcgaacgggggctcccccatgttccccgccttcaaggtgatgccgcccgcacagcctgagccgcagaccacggcgtcgccggaggattccggttcgcgtgccgctgatgcgcaaggtgccgccaaggagtcagtgcaaccggacgaagattcccgcacccctcggcattccgcggagcagaccggcgactctcgcccagcggcggcgcaggaacgcgaggattccgctgtgcacatggcacgacccgacgagcagaccgcggaatcccaccgcgagccggagcacgagccggcgcagcaacccgtgacctcgcattacgacgaggcgattgtgcagaccttcgaagacatcgacccggtcgccggcttcgggccaagcgtggccggcaccaccgcgccacaatacccgccgcaaagcgagatgcagggttcgttcacgccgggggtcacaggcaactaccgcgatccggtgactcatctcaacagcaacgacaccttcgacaccttcatccaaggcgattccaaccgattcgcccgcacggtggcgctggcagtggcggagggctcgggccgcgactacaacccgttgtgtatctacggcgggtctggcttgggcaagacccatctactgcacgccataggcaactacgccgtgcagaaccagaagccccgcccgcgcgtgctctatgtgacgagcgaggagttcacgaacgacttcatcgagtcgatccgcacctccggccaggacaacgaagacccggccatggagaagttctaccgcaagtaccgcgaagtggatgtgctgctcatcgacgacatccagttcctcggcggcaaacgcggcattctcgagcagttcttccacacgttcaacagcctctaccaggcgaacaagcgcatcgtcatcgcctccgacgtgccgccgcacaatctggaggatttcgaggaccgcctcatctcccgcttcgagcagggcatcaccgtggacgtcaagccgccgaatctggagacgcgcatcgcgattctgcgcatgctcgccgagcagaaccacattcgcgtgccgaacgacgtgctcaatctcatcgccgaacgcttcgccaacaacgtgcgagaactcgagggcgcactcaagagggtcatcgcgatggcctctctcaaccaccagcccgtcacgcgtgcgctcaccgaacgcacactgcaggatttcttcaccaccgacgtggaggtgaagcccaccgacatcatcgcgcgcgtcgccaaatacttccatctcaccttcgacgacatcgtggggccgggccgcccgcgcagcgtcacgctcgcacggcagattgccatgtacctgacgcgcgacatgacgagcatgagcctcatgaacatcgggcagatcttcggcggccgcgaccacaccaccgtcatgcatgcgtgcaagcatatcgccgacaagatgcaggagaaacaggagatctacaactatgtgaacgagctcacggtggagctcaagcagcacctcaacgactgacgcgtccgggcggtctggcccgcatggctggggacgcgtgagtatagcagcacggaacgtggtcgggaaaccggccacgttttttgctgtgcgcatggcggcggcacgagtcccggcggcgcggcacaatgaacctttgtatgtgaaaagggcggaaaatcaacgcacacggcttggtgaggagtgaaaacaggttattcacatagttatccacatttgtgggcgaagcctgtggaaagcatgtgtgaaacgccgcagcccgctgtggaaaagggctgagcgattgtggataactttccgggcttgcgacggcggtggataaaccgcgaagttatccacatgttgtcccatggttatccacagcgcacacatgtggataacgcccgtgtttactgcactttccacagttatccacaatatccaccggacttatgattactactagcttacgtttcttataaaactcgtcgtcatcaacatccggcggtggattgcacacgcagattcccttcgacgtgaacgtcgctagaatgaaaagcattgagcatagctcgtggaacacgagcgccatgcacaccgagcctttatccagcaaggagagccatgaaagtagaagtcaacaccgcttcgttcgcagacgcggtagcttggacgacgagtgtgatcgacgcacgccctgccaatccgattctcgccggtgtcaaacttgaggcggcagatggcacgatgcagctttccgcattcacctacgaaatctccgcgcgcgaccacatcgaagcgggtgttgacgaatccggcaccgtcgtggtgctcggcaagctgctcgcggacatcagcaaggtgctgcctgccgagaaaacctatctttcggccaacgagacgacaatgaccatcacctccggcccggccacgttcacgctgcagctcatgccggagagcgagtacccggatctgccgcagctgcctccgcagattggccaggtggacgccgaaaccttcacgcagaccgtcacccaggccgctgtcgccgtggcccatgacgagaaccgcccggtgctgaccggcgtgcacatgcgcttcgccggcgaagaggtgacgctgagttccacggaccgcttccgtctgggccgtgccagcttccgctggacccccgacgaggccgatcttgacactgcggcgctcgtgcgcggttcccacttggtgaagatcgcccgttccgttgacgagcgtgcgaacgtggtcatctacctcgaccccgctaatccgaagctgatcggcatcgcgaacgccgggcgtatttccaccgtgcagctcatcgatggcgaattccccgccgtcgaccggttgtatgccgattcctacccgattcaagcggttattcgcaaggaagatctgctcggcgctgccaagcgcgtctcgctggtggccgaacgcaacgccccgatccgcatggtgttcaccgaccaacagctcacactcacggccggcggcgccgatgaggcctcggcgaaggagacgctgcagatcgacctcgatggcgaagacatcacggtggcattcaacccgtcctatctgcgcgaaggactgagcgtgatctccgaaccgtatattcgcatgaagatgacgaccgccgtgaagccggtggaattcaacgggcagcaggatgaggatggcgaggagtcgatgagctatcgatacctgctcgtgccgatgcgtttcaacgtctgattcgcagtgatgcagcattgatttcaagttcaggaaggaagtggcatgatcaccgtatctcggctggcgcttgaccacttccgttcctggacgaattgcgtgctggatttcaaaccgggtgtcaacattctggaaggcccgaatggactcggcaaaacgaacatcgtcgaggcgctcgaggtgctgtccaccggctccagccatcgcgcctcaacgtctcagccactcgtcgagcaagggttccccgcagccgccattcgcgcgaatatagaagaactatcggaagatttcgaaaacaacaccgagacaatagatgaccggacgaccaccttcgagctgacgattcgggtgcggggagccaaccgtgcccgcgtggacggcggtccgagcctgtatatgcgagacattgtggggcgcgtgcccctcgtcgcattcactcccgacgaccagcgtctggtgtggggcgaccctgccgtgcgccgttcgttcatcgatcaggccgccagcgtgctggttcgcggctataccgacctgttgcaacgcttcacgcatatcgccaagcaacgcgcggcgctactcaagcaaatcggtgcgcaggagggcgtctcggtgtccgaggaggcgcgccagatgcgcatgaacggcttggaggtgtggaccgcacagttcattgaaaccggtctggaactcacccgacagcgcatggcagtcatcggcatgctcaacgaatatttcggaacaatcgtacaggaattaagtgatgtcgatcaaacggcgacgctcgtgtatgagccgtcgttcgacgagctatacctcacccaaggggccgaggcaggggagcaaggcggtcccgagcgggtgaaggcggcgatcagcgagcatttccagcgcatctacacgggggaggtggcgcgtggggtgaatctgatcggaccccagcgtgacgacgtctcgattgagctcaacggcatgccggcacgcgaatactcgtcgaacggagaaagctggacgctggcgctggccttgaaaatggccctctaccgtcttctggaacgcaaggcgggggaacggcccatcgtggtgctcgacgatgtgttcgcgcagctggacccgtcacgtcgtgcgaaaatcatggaattcgcgttgaggcaggaccaggtgatcatcaccgttgcggcggccggcgacgtgccggaactgcctggcgacgcccatgcccatgtgatcgatgtggcggcattgaagctgcaggggagtggcggcgaaggcaccgctttcatgccggagccactgccggccgacgaccccttcgccggtcagctggccgccgtgcaagcctcccggcgaaccgctggcatgcatgcaggcagtgatggcaaacataaggtcgaacaatctgcagaccaatcggcagaacaggtttcgggtgagcgtgaaattggtctgacgaaacatgaaagtgcacacgcatgagcgagccacccatagcagtgacgttgaagctcgatgagagggcattgccggccgaggagttcgaacatgtctcggcacgcgccggactcattgcggaacggcgcgtgaagcgcgaggaggcgctcgagaacttcggcaaaccggggcgcgacgaggtggcgttcggctcgttgttcgcggggatcgccaaacgggccggctgggtgccccatatgaaactggcccaattgcgtcacgattgggcgtcgatcgtgggcgatgtgatcgcacgcaacacctgggtgggcgccatcgacaacggtgtgctcaccatccacgcgaagtcgccgtcgtggaccacgcagctcacgttcatgctgcccgagctgcgcgagaaggtgctcgagcgcctcaatggcctcgacatccgcgacattcgcgtcacaggcccgcaggcgcatgggcccgccacgcgtcgcaagcaatatgtgcggcagaacatgcactaccgtccacagtgatccaactcggaccgcttgtgcggcgaaaaaccaggaaatccgctacaagcgcgctaagaacacgagtccccccatgcgagtagaatccttagtagtgtagttgaacgcccacaagggcgttttattcgtgttacagggcatatcgcctgtgtgagaacccttcgtagcgcattcacagaaaggaatctctgtggcagatcaaccaaccgattccgcagcggagtcgcttgagtcggcgagcaacgatccgatcgatcagaaccttgaagccaacggcacggaccagaacgacgaacagttggacgacaccctgtctcccgagcattacgacgcgagcgacctgcgcgtgctcgaagggcttgaggccgtgcgcattcgccctggcatgtacatcggttccaccggtccgcgaggcctgcaccacctggtctatgagatcgtcgacaactcggttgacgaggcgctggccgggtatgccacgcacatcgaggtgacgatcctgcccgacaacggcattcgcgtggtcgacgacggccggggcattccggtcgacgaagtgcccggcgaaggcaagtccggcgtcgagaccgtcatgacgaagctgcacgccggcggcaagttcggcggcggcggttatgcggtgtccggcggtctgcacggcgtgggcatctcggtggtgaacgcgctctccacgcgcgtggacgtcgaagtgcgccgacagggctactactggacgcagacgtacatcgaccagcatcccaccggcccgctcgagcgcggacgtgcgatgcgcgacgacgagtccaccggcacgtcggtcacgttctgggcagacccgaagatcttcgagacgacaatctacgatttcgagaccctgcgcagcagattccagcagatggcgttcctgaacaagggactcaagatcacgctcaccgacatgcgccaggtcgacgaggcgcgcgacgaagtggccggcgacggcgacaacacggtggaggagctgcaccagaccgtcacgtaccaatacaagaacggcatcaaggactacgtggcgttcctggtgaagtcgcgtggttccgcgccgatcgagccggatgtgatcgacatcgagtccgaggacctcaccataggtgtttccgcggagatcgccatgcagtggacgtcggcatattcggaatccgtgcacaccttcgcgaacacgatcgccaccaccgagggcggcacccatgaggagggcttccgcgcggcgctcacgagcatgatcaaccggtatgcccgcgacaagaacatcctcaaagacaaagacgacaatctctccggtgacgatgtgcgtgaaggcctgaccgcggtgatctcggtgaagctgacgaacccgcagttcgaaggccagacgaagacgaagctcggcaactccgaggcgaagaccttcgtacagcgcgtgatgaacgagaaactcggcgactggctcgacgcccatccgaacgaggcgaagaacatcatccagaaggcgctcgaggcatcgcgcgcccgcttggccgcgaagaaggcacgcgagaacacccgccgcaagtcgatcttcgagtccgccggcatgcccgacaagctcaaggactgccagtcgaacgacccgagcgagtgcgagctgttcattgtcgagggcgactcggcaggcggctcggccattcagggtcgcaacccgctgacgcaggcgattctgccgctgcgaggcaagattctcaacaccgagcgcgccagcctcgaccgcatgctgaagtccgacacgatcgagtcgctgatcacggcgatcggcggcggatacggcgaggacttcgacctcgacaaggtgcggtaccacaaggtgatcatcatggccgatgcagacgtcgacggcgcccatatcgccacgctcaacctcacgctgttcttccgctacatgcgccccatgatcacggccggctacgtgtatgtggccatgccgccgctctaccgtctcaagtggacgaagggcccgcacgacttcgtgtacacggacgccgaacgcgaccgcgtgcttgccgaaggcaaggcgaacggacgccagctgccgaagggcgagggcattcagcgctacaagggtctgggcgagatgagctaccaggagctgtgggagaccaccatggatccggaccaccgcattctgaagcaggtgcatatcgaagatgccctgcaggccgacgaaacgttctccatgctcatgggcgacgaggtggagccccgccgtctgttcatccagcgcaacgcacacaacgcccgctggatcgacgcctgatatgggccgcccacggcgacgggccgtggcgtgtgtagacgtagcaacagcaaggtaaaggatttcaagtggcagacgaaccaaccaacaacggcctcgacaacggccctgtcaacgactccggcgacgaacagcatctgccggacggctccctggagccgctcagcccgcaggaggccgacaacaccgactacggcctcatggtgggccagcgcgtgcagccgatcgatttgcaggacgagatgcggcagtcgtacctctcctacgccctctccgtcattgtggagcgagcattgcccgacgtccgcgatggcatgaagccggtgcaccgccgtgtggtctatgcgatgtacgacggcggctaccgcccggaccgcggctacaacaagtgctcgcgcgtcgtgggcgacgtgatgggcaagtaccacccgcacggcgactccgccatctacgacaccttggtgcgtatggcccagtcgtggtcgatgcgctacctgctcgtcgacggccagggcaacttcggctccccgggcgacgacccggcggccgccatgcgttacaccgaatgccgtatggcgccgctcgccatggaaatggtgcgcgacatcgataaagataccgtggacttcgtgccgaactacgacggcaagacgcaggagcccaccgtgctgcccgcccgcttcccgaatctgctcgtcaacggctcctcgggcatcgccgtgggcatggccacgaatatccctccgcacaacatgcgcgaggtggcagatggcgtgcattgggcgctcgaccaccccgaggccagccgcgaggagctgctcgacgccctgatcgaacgcatcaagggcccggacttccctacaggcgcgacgattctcggccacaagggcatcgaacaggcttaccgcaccggccgtggcctcatcacgatgcgtgcggtggtcaacaccgaggagatcaagggccgtatgtgcctggtcgtcaccgagctgccgtaccaggtgaacccggaccgcctcgtcgcctcgattcgcgaggccgtgcgcgacggcaagatcaccggcatcgccgacatgcgcgacgagacctcgggccgcaccggccagcgcctcgtgctcgtactcaagcgcgacgccgtgccgaaggtggtgctcaacaacctgtacaagcactcccagctccagcagaccttcggtgcgaacatgctcgcgctcgtcgacggcgtgccgcgcacgctgagcctcgacgcattcattcgccactgggtctcccaccagctcgacgtgatcgcccgccgcaccgcatacctcaagcgagaggccgaggaacgcgatcacattctgcagggctatctcaaggccctcgacatgatcgacgaggtgatccacctcatccgctcctcgcagaccgtggagattgcccgcaccgggctcatggatctgctgggcgtggacgatgtgcaggccgacgcaatcctcgccatgcagctgcgccgcctcgccgcactcgaacgccagaagatcctcgacgagcacgatgagctcatgcgccggatcgctgactatgccgacattctcgccaagcccgaacgccagcgcaagatcgtcggcgacgaactcgacgagatcgtggcccgctacggcgacgaccgccgcacgaagatcctgccattctccggcgaaatgaacgtggaagacctcattgccgaggagaacgtggtggtcacggtgacccacgccggcttcatcaagcgcacgaaggccgacgaataccgcgcccagcaccgcggcggcaagggcatcaagggcgccaagctgcgcgacgacgacgtggtggaccacttcttcctcaccagcacgcacaactggctgctgttcttcacgaacaagggccgcgtctaccgttgcaaggcctacgagcttcccgaaggctcccgtgactccaaggggcagcatgtggcgaatctgctgcagttcacgcccgacgagtcgatccagaccgtgctgtcgatcccggactacgaggtggccgattaccttgtgctcgccacgcgctcgggcaaggtgaagaagacgcgcctttccgaatacgattcgccgcgtcagggcggtctgatcgccgtgcggctgatgcaggacgaatccggcgagaccgccgacgagctcatcggcgccgcgttgtgcaatgcgaccgacgacatcattctcgtgtcgaagctcggcatgagcctgaagttccgcgctgacgacgagcagctgcgaccgatgggccgccagaccgccggcgtgcagggcatgaagttccgcgcgggcgacgaactgcttgcgatggatgtgatctggggcgagaccgacaaggacctgctcgtcgtcacgaaccagggcttcgccaagcgcaccgcgatcagcgaataccgcctgcagggccgcaacggcttcggcgtcaaggccgtgcagctcaccgacgaacgcggcacgctcgtcggcgcggtcgtcgtgagcgaggaagaccagatcatggcaatcatgaaatccggcaaggtgatccgctcgaatgtgagcgaggtcaaactcaccggccgcaccacgcagggcgtcacgctcgcgaagccggatgccggcgacgagatcatctcgattgcacgcaatgccgagaccgaagatgaggcggacggcgacaccgtcgtcaccgaatcctcggccgaggccaccgcaacacaacccgcacagggcgagccggtgttcgaggtgaagtccgaaaacggcatgccgatgatcgaagaggaatccgcggccatcgacaagaccaaggaagagagccgagaagagtgagcgtcgcacgggatctgccggacataccgcggtattcggcagatcccgcccatatgcgtggcttccggtgcaaggtcttgaaacattgatactctcgaaccgtatattcttttcaaggagcgattatgagcaacaccaatccgcttgaacccggccaacagcctcgtgcggccgcatcgtctgccgctgacaacgctccgcgagtggcacgctcggcctcgaacacgccactgatcgccgacagggatcgccctgaggagaaccgaccggtacgcccgatccgcaatcgcaagaagccacacgcccgccgcatgaacctctcgctcacccgtgtgagcgcatggtcggtggccaaggtgagcttcatgctctcactcgccggtgccatcatccagatcatcgccgtgctgttcctgtggctgctgctcaaggcggtcggtgtattcgaccaggtgacgcagatcttctcgtccgccggtctcgactcgggcagcatcaatctgtcgaacatcctttcgttgccgaccgtgctcagtgcggtgacgatcttctccatcgtcgagatggtgatcatcaccatcctgtgcacgatcttcgcgttgctctacaacgtggtcagcgcgctcgtcggcggtgtgcacgtcacgctcggcgacgactgatccccttcgttccgcttcggcccctcctcggaggggctttttcattggtcgcgccttcgctgcgcctgtgatgacccacatcgcgctgcctgccgcacgcaaatcattcctgtgaatgagtacgacgggcatgcggctgggctacactcaacactgtgtttaggtatctagggtcgttcagccaatcgttcacgctggcactcatgctgtggccattcgtgtcgttgctgctcacactgccgattgtggcgttcgtctaccaccgcaaccaccggctgagcttcaccagcgcgttctccgcatacgtggcggtgctgtatgcactcggcctcgtggccttcaccatgtacccgatgcccgacgaccccacgctcttctgcgccacgcacaacctcgccccgcagctcgacattctgcggttcattcaggatgcgcagaccggcctgtacggcgtgctgcaactcgtgatgaacgtcgtgctgttcatgccactcggcttcatgctgtgccgttgggccggctggagattctgggtcacctccgccttcgcactcggctgctccatattcattgagacctcgcagctcactggaatctggggcatctacccgtgcgcgtaccgccagttcgacgtcgacgacatgctcacgaacacgctcggtgcgatgctcgggtatgcgtgcgccctgctctacacgaaactcgtgccgaagaaagcgaagcagctcaccggcacgaacacgcgaccgggattcgtgcaccgcatggtctccatgtgcatcgacttcctgctcatcgcgctggtgtacgtgccactgagcatcctgtacatcttcctgttctacctggtgttcaaatcgaccggagacggccattacgtctggctgtcgctcaccgtggaaccgcgcgtgctcgactacatgacgtggatcaccgcggccctctcgttcctgctgttcgaggtgtggattccctggcgtcaccatggccagacgctcggttgccgctacacccacatgaccatcgagacgcgtgatcgctcacggggccagcgcattgcgttctacgcaatccgcacgctgttcttcggcgtcatattcggcggtctcgccacgaaccacccgatctggggatggacgttgcttgcgctgctcatcttctggcttgtcaagaagtgcatgccgtgggatctcgtgccggggaccgatccgcagacgccgcccacttcgccacagccgcaggtttccacgctgccggaaccgaatctgcagcgatgaataatccgcagacatggcatacagcgagacggccaccggaacacacgaatcccggcagccgaattgctgcatacgaacggttacatgagcgcgcgcatgcgcagcaccaccatgaacagtgcgatcacatggcacacatagccgccaatggtacccaaatggaagagctcgtggaacccgaaccacttcgggaacggattcggcttgcgcaacgcgaagcatacagcgccggcaatatagcaggctccgccggcgatcacgagaatggtgggcacaggcccgatgtacggggatttccagaacagccagatgattgtgatcggggcgagtccgagcacaatgtagacgatggtgaacagccagtcgaggcccaccgggtagatcagatgcacgaacgtgccaagcaatgcggtgacccagaccacgcccacatacacccagcagatcaccgtgttgttcagtgcgaagaagaacggcgtgcaagtgccggcgatcaccaggaagatgttcgaatagtcgatgcggcatagtacgtcgtcgacggccttcggaaaatacccgtggccgaggtggagcgccgcgctgttgccgaacagcaggatgatcgtcgcgctgtacacgctgatcgccaccttcatccagccgctcggcgccaggcagatgaggatcaccgaggtggccacggagaacgggaaggcgatgagatgcagccatccgcgcagcttcggtttttccagaaggatctgcctgagctgcatcttggtgcggtactgctcgttgcgcttgctctgcgcgcggagtttcttcgccgtcaccactttgcgtggtttctgagaacgcgtgacctggccaatatgccggttgttgcgcttcatacgggaatcttcgaggtacgaactgcgcgggggcttgcgctgactgggattcgctctcctgtttgccatattgcccagcataggaagttttgtataaaacggccgcctgagttattcctacaggaaattgcatgcagcattcttgcgtaaaaggggacagattccatacccgatttgtctctttttacgcaggtgagggcagccatcgcggaaggtggcgtggggctgtgctgcttatttcctgtgtacagctctccttctgcgtacggctccctttctgcgtaatttgggacaggttatgcggtgtatctgtctctttttacgcaggctcgggtttgcgttggttgcactctgaactgcaccccgattatgagattgcactcctccttctcctccttcgctgcgtaaaaagggacagattagtgagctaatctgtccctttttacgcagcgaagacgccgagggcgcccctgggcgcttagaagatgccctgcgcgaccatcgcgttcgccactttggtgaagcccgcgacgttggcgccgaacatgaggtcgccgtcgtgtccgtattccttggcggcatcgagcgattcggcgacgatgttcttcatgatgcccttgagttcctcgtccaccttctcgaagctccaggagagacggtaggagttctggctcatctcgagaccggagaccgccacaccgcctgcattcgctgccttggccgggccatagagcacatggttcttctggtagacctcaatggcctgtggcgtggacggcatgttggcgccctcgcagaccaccgtgcagccgttgtcgacgagcttctgggcagattcgccgtcgatctcgttctgcgttgcacacggcagcgcgatgtcgcacggcacggtccacacctcgcggcaaccttcgtggtattccgcgccgtcgacacggtcggcatattcgcgaatacggccgcgcttgttcagcttgatgtctttgaccacatcgagatcgatgccgttcgggtcatagacatagccgttcgaatcggagcaggtgaccaccttggcgccgagctgcgtggccttctcaatggcgaagatcgccacattgcccgagccggagaccaccacggtcttgccttcgaacgagtcgtcgcgcagcacgcgcagcgcctcctgcgtgtagtagcacaggccgtaaccggtggcctcggtgcgagcgagcgagccgccgaattcgagtcccttgccggtgagcacgccggcgaactcgttgcgcaggcgcttatactggccgaacagatagcccacctcgcgtgcgccgacgttaatgtcgcccgccggaacatcggtaaactggccgatgtggcgctgcaattcggtcatgaatgcctggcagaagcgcatgacctcggcgtcggagcggcccttcggatcgaagtccgagccacccttgccgccgcccatgggcaggccggtgagggagttcttgagaatctgctcgaaaccgaggaacttgatgacgctctcggtgacggtggggtggaagcgcagaccgcccttgtacgggccgatcgccgaattgaactgcacacggtagccgcggttgacctgcacgtcaccgttgtcgtccgcccaggccacgcggaacttcacgaggcgctcgggctccacgaaacgctgcagcacgccggccgcctcgtactccgggtgcttggcgaacaccggctcaatgctttcgaagacctcctgcacggcctgcagaaactcggactggtccggatcacgcgcttcgacctgcgcatacacgcgcttcacatactcatctgtgagcattattcctctttcgtgttggcgaataaacctccctcattgtaaggagcgcgtccatatatgtgaagagtgtttttcaattattggatatcggcaggcgcgcgctgtgccggtctcagatacgcggcgcgcgctcgctgctttgaatggtgcggtgtgcgaaggcgtacacaatccatgcgactggcatcgtgagcaacaacgcggggtagaaccagatgattggcaatccgccgtacaggaagccgccgatgagcgggccgaggaacatgcccagatcgatgcccgcatagtatgtcgtgttcgccatgccgctgcgtgccttgccggcgatgagcacggcgcgcgcctgcgtgaccgagctcatcatgccgtatgcgcccaccgtggcgagtccggcgagcatgacgaaccagttgttgcgcatcacggtgagcgaggcgagcatgacaatctggcagattgttccggtgaccatgaagaacaggaaactcttcgtgtcaaaccagttgcgcaacacgatgcgcgagatgagcaacgtgatggcatagcacgggaagaacagcgagacgatcacatgggcgtgccgtgcgttggcgtaatccacgatgaacgactggttcgcgaaatacggtatcgcgaacagcatgaagatcagtgcgatgggaatcacgcgcggctcgaacagcgagtcgaggcgaatatggtgacgctcgccgccttgctgccggccgagtctcgcacgcggtggcttgccgccgtctttgatgagcagtacgcagatgactatgcagcaggtgagacccacggcgatcagaaaggtgttgcggtagccgattgctttcgacgcgcggatgcccagatcggggccgaccgcctgcgcgagggcgttcatcgtgccgtagagccccatccccgcgcccatgcgcgagatgggcagcagcatggagagccatgtggacaggcataccgagatgcaggcgaatccgacgccgttgagtatgcgcgcggccagcagccatgcggtgttcggcacgaagtaataccccagattcgacgccaggaatatgagcgcgccgatcaccgcgagcttgcgtttgctcgtgcggtcggaaagattgccggcaatcggtcggcagatgagcgcgctgagcgagagtgcgccggcgaggaagcccatgagtgcgccgcttgcaccgagcgattgcgagaagccggcgatgattggcgtgcccatcatgctgcttgtcatatagaagaacgtggccgccatgatgagtgccacatcgcgggtgatgagccgctccctggctttgccggccgcgcgctcgccggcgctcgtggtgtagccgctgggattggattgccgctgcgtgctgtcggtggcactgtcggtggcgctgcttgtcttgcggtgtgtgttgttgccggctgtcatgatcacctctgtttcggtttcagtctagttgtggcgtgggtgccgcggtgtgcggcgcgcgcaaggcgaacggctccgatcacaagcttgtgatccagatgaacgccaacggagtcaccttcgaggcctatccgtcgctcaagggcaaggatgcgcaggtgagacaagccgggcgtgtggaacgtggctagctgggacaaggacagtgccggtaagctgcctaatcagaagctgctctcgaaagtcggctccttcgccatctatgtgaacgacaacgacaacgagctgcagaacaacgccggccgtccgcgtaccggcgacctcgtgttcgattcgatcaagctcgtcggcgaacgcgatccgtatgtgccggaggagaagtcttccgagccgtccaacgccaagctgatcacgatcgacgacttcgaatcgtatgccgatgaggctgcgatgaaggaggcttggggcaaccgtgaacacacggatgtgctctcgctgacaaccgaggatgacgacaacaagtacctgcagtactcgaacccgcacggtggctggctcgatgtcgcgacgttcatccagaacgacacggcccgcaacaactggaccggtttgggtaagctgacgttccgtctgaagcacgatggttcgaacaatgcgatggacctgcagatcggcaccgccgacggcaagtacttccatgtcgaccagaagctggcttcggaggatggcgccgattggaagacggtcgagatcgatcttgtgaacaatccgtcgctgacgcagagctggccggaggatgagaacaaaggcaagacgatgaccgccgatgaccttgcactcttcaaggaggttgtgattgcaggcaacacttggaacaaagattccccggctgtgaacttcgccgtcgatgacctgaaggtcgttccttccggcgacgcctccgactcgaagccggagaccaagcctgaggaaccgtctgagcctaccgaaccgaccgagccggaggagacccccgactattcggccgatatggcagctggcgatccggccacctgcccgatcgacttcactcagcaggacactgaggatccgtctgatccgtctgatccggaccagcccaccgacaccgacaagcctgctggaactgacaagcctgcggatgcgaacaagccggcggcaggtgacaatgctcagtctggtgacaatgctcagtctggtgacaatgcccagcagtcgaacgccaaggcagacgaaaacaagtcggtggtgaacaccggctcctcgattgccgtggtcgcagccatcgccgtggcccttgtgcttgcgggtgccgcgacgctcgtctgggctcggcagcgccatcagcagtagtctccaatgacatctaactgaataacggcatatagccatatcaggtcggcgtgcatgcatatgcgcgtgcgccgacctgtcgtatctggtcacctgtaggaaaaagtgcggcgtgaatatcgcgagagtgaaattcgccaagctttttcccgtgtccacatattatggcaactgaacatattcccgttgggtcccgtgagctgctaggcctcggagccagtggtaccgtctgaacaaggagagagatatgatcgacgggttcaagaaattcattgcacgcggcaatatggtcgacatggcagtcggcgtcgtcatgggcgcagcggtcactgcagtggtgaactctgtggtggatggcatcatcaacccactcgttgcagccatcttcggcaagccggatttgagcaagacctggaattggaccatcaccaactgggcgggggagaactcggtgatctcgttcggctccgtgctcaacgcgctcctcaacttcctgctcatcgcactcgctgtgtacttctgcatcgtcgtgccgatcaacaatctgcgtgacatgacggagaaggccatggccaaggtcaagggcgacgattccgacgtggccgccgaggaaccggatctctcgccggaggaacagaccgtgatcctgctgcaggacatccgcaatgcgctcgccgcccagcagcccgccggtgctcatgctgcaccggttgccacggataccactgccgcaccggaatccaagtgatgcgcgtatgggcatgggcatcgcagtgatctgacattccgatatccattctgacatcgctgaaaggcgctcggttgtaccgggcgccttttgtgttgcagcgtctgtggtcatttgctcggatgcttccgtgggatgggccgtggtgggggcggtttgcagtctgttttgcggatggttccgtgagatagaccgtgatgatagtggtttgcggcttgtttttcggaatcttccgtgaaacgggccacagtggcgatgatctgcggactgttatgcggaagcttccgtaaaatctgccgtggcgaagacaacctgcgcattccatccggcgcgagctccccgctgttcgaatgcgacatcgaacgccgcaccacgccccgtctgttccgcgatgtgcgcgtgcgttacaagaccgtctttttcttgattatggtcggtttgttatgcggggatgcggtaatcgaccatactgcggagaactatggtcgtttgctgacgcagatgtatggtaatcgaccatacttgccgtgattatggtcgttctgttgtatgtatgtgcagtaaccgaccatagtctgcaaaatatcgttctttgccggtgtgcagatttgcatgtctggcagataccgaaaccagctgcgttgttttgttgtttgctctgatgtgtgtggaagatagaatgcaaaaagaaaaaccgttgaaaacctaatgttttcaacgaccatgcgagtggagctacccgggttcgaaccggggaccctctgcttgcaaagcagatgcgctaccagctgcgctatagccccaacgggggaacacgtgagaatgctccccacgtgggcccgggaggacttgaacctccgacctcatccttatcagggatgcgctctaaccacctgagctacgggcccaatccatcacgttgttcaacgcaacagatagaaagaatacctgtgcttctcgattaatgcaaatcgacgctcgttcggcgtgtcgcacaattcccaggtgggtgattcattcgaacatttgtctgaatagttgcacagaatatggtcatgccattcaattccgtccctcgcgctcgttccatttcacggcgtgctcagttcgaccgttccacgcgcgcccgcgaagtgctcaatgtcgacggactgcaggtcaatgtgctgcgcaagaagaaccgcaacatgtacttgcgcgtgaaaccgccatatggggcgatcgaggtcacggcccccgtacgcatgccgcagcacacaatcgtggagttcgtgcgcgaacgccgttcctgggtcgacgaagcgctgcataaaatggcacaggctcgttcacggacgttcgcatcgcccgacctcgaccccgacgtcggcggcagtcgcacgacggtgttgcgtgatgcgcgcgacccaggttcgccccggatggaaacaccgcatgagaccagtagtttcacgtggaacgaggagtatgtggagcgtgcccgccgttcgatcgaacagcaactgcccgatttgctgagcaagtggacgccgatcgtcggcaaatctccgacaaaaatcactctgcgcaccatgacatcgcgatggggttcgtgcacgccgaaaacggggcggatcaggctcaatctacaactcggactcatggatccgcagtttcttgagtatgtactcgtgcatgaactcactcatctgtgggagagcgggcacgggcggacgtttcaggagcgcatgagcctcgtgttgccaaactggaaggaactgcggcgcgaactcaaccgctgcacgatcttcgatgtgccgcagtcgcgcggctgatgcgtccgcatggccgagcgtcggtcagtacttattcgctcccgtgccgatgaagttcgtgctgatgccgcgctggtagtgcaggaacatgtctgcgccatagcggtcgacggggcggtgtgtgaacagcatacggatcgcgaacgcggtctgcgcgtccttcggcaatgcgagaaacgccgcatgtgcatcccagtacggggtggtcgtaatcgccgcgttgggcacgtatgcgtacccgtagccatcctcgttcacgtaccccatgaacggcagatcccacgcgttgtgcttggtgagttccttcttgaagtcttccacggcggccaacgcgtcttcgccgactccgaactcccgtgcgatctcgttcgcgtgtgcggtcttctcttccggtgtcttgtcgaacatgtcgaggtcgacggtgatggtgtgcttcgttgcttctgccatgggggttccttgcataatctgcaaatcaaacatttcatatgtttgattatgtgtctgttaatgatatgtttttcagtatgaacatcaattgtgttattgctcacaattggtatccatgtgctagtatagcatgccaatactgtaataatcgttgataacagagggttttgtcataattgcatattatctctgccgaattggtctgttctgttgatttgtgaattgtcgtgttctgtcgatactcaaaacgaacacttacgatgttctgtttttaagttaaacgaacatttatgtgaacatctcggcgtgtcgtgacgccccttcattatgcgatccgatacgccactatattttgaagacaccgtagcaccctaccgtatgcgcacaggggtacgcataccatgccgatcccgcggaacggctggtcgagcagaacactgccgatactgttatgtgacgtcctttcgatgctgcgccggtgctggtcattttcttctaccatgagaccgtcgagaaataggcgcgcatgactgacgctttgccgaattgggtggcgatgcgtcgcgaactcagccgatgcaccatcttcgaagtgtcgcggtttcacggctgatctaccctcgtgcgcgagatgcagtcagtcgatggtctgtttgcgtgtgtaggtgcgcagacggctctgctttttgccgattgcggtgatgacaccttcatccacgagctcgcgcagaatgcggtgcactgtctgcaggcttttgcctgtcgcctccgcgatgtcgcgtgcgctgattgtgccgaacgtggggatcgtgtcgatgatggcttgtcggctcgatggcgctgctgctggaggcgctggggcatcgctggcattggtgatggccggtgtctccggaggttcatatatgtcggtagccacctgtctgatgagcccggattccaccagcgtggccaatatcgcacggatgtcgtctgaatcatatccgagccggtctcggatgtcgtagacacttgcgcggccaagcgcgcgcaccgtgtacagcactgaactttcgcgtcccggcaggtcgtgccccacatggcttcgcacccactgctggtttgcagcaatctcggcgccaccacgatacagaatcacacggaagcgatcgaaggtcggatggaaatccggctgtgcgagtgatagttccttcattcggttgatcatgaactggatgcccgaaccttggccttccacggcggatccatcgtgatcgccgcgaatcaacggcgtcttctgtagcagttgcatcaacgtggtattgcggcaccgggatacaccattggtcagattctgcagtgtcttgccgccccacagattgccggggctcgaaatctccacacgatcggagtacacgtcaatattcaccgggtcgttgcgaaacaatgtgtcgtattccctgtgtaccacggcattggcgattgcctcgcgtagtaccacagttggaatctccggtacatcgcgccttccgttcccctcgtgagggaataggtacgcagattgcgcaggacggctttgaccgcgtcatcgaccatttcctgcagtcgaccatggcactgcacgcgatcgaggaagcggacttcgtcatcttgagatttgctgatgcccggatgaacagcgacatccacatacaaccgagggaagaactgctgtggatatacgcctgcgatgagtagtccagcgagacgcacatgaccgtttttgtcaagaatgttcaagcgttcgagctgttgcgtttcgctgtgtgtaccgcgtagcgccttctcgccgcggtgtgcaacgccgatgcccacgcatgcatatccgcaatcccgacatcgtttctttccaaggccgcacaggccttcccggacgatgtgtgaaacggaatggcgggttccaaaagctgattttgacacggaatgatgggttgtgaagtctgatttcagcacggaatgatggattgggatagtgggcacgcgctgcacaccacaagcgctcgcggggcgcgtgaacgtctataaccgcatatcgccaaccaaggcaccatgtggcagcattcgcagggttgcttccatacgcatcacaactgcgcatggggtgcaggaacacacgcacgtcaccttgggcggcatcgagcagtatgtgcagattcgaggcgaagaccggcgtaaccccgtcatcctgtggctgcatggcgggcaatgcaccgtgcccgattactcgtcgcggagtggagatggcgcgctcagtgcgcccacggcggagtgcacgcgcgggctttacgctcggcagtagcgaatatgaagacggcgaatgcgtaaggaagtggcggcatggcacagaccatcgatatcaccggcgctcgtgtgcataatctcaagcgcgtggatgtgcgggtgccaattggcaagatggtggcggtggcgggagtctccggttcgggcaaatcatcgctcgcgctcggcgtgctttacgcagaaggctcgcgccgctacctggaagggctctccacatacacgcgccgccgcatctcgcaaagcggcgaggcgaaactcgacgcgatcgagcatgtgccgcccgcgctcgcgttgcatcagcggccgagcgtgccgggtatacgcagcaccttcggcacgatgagcgagctgctcaacagtctgcggcttatgacctcgcggctcggcaattatacctgcccgaacggccatatgctcgacccgacaccgaacgtcgcgctcgaacggccgatcatctgcccggtgtgcggggaggaagtgcaggcgctcggtgcggaggacctcgcattcaactcgggcggcgcgtgcccgacgtgctcgggaaccggcatcgtgcgcacggtgaaccaggcaacgttgattgcggacccgaatctgacgatagaacaaggcgctgtggcgccctggcgttcgctcatgtggtcaatcatggtcgacgtatgccgcgaaatgggcgtgcgcactgacgtgccgtacaaggatctgaccgcgcatgagaaggagattgtgctccacggaccggccgagaaacggcatattatctaccattcgaagaaagagaaccgtgccggcgagctcgacttcacctatttcagcgccgaacgcaccgtgctcaacgcgctcgacaaagccaaggacgccaaggcgctgaaacgcgtggaaccgttcatcaccgaggagccatgcccggactgccacggcacgcgactcaacaaacgcgcacgcatactgccggtggatggcaagacgttgcccgagcagtgtgcgatgcagctcgacaatctcgcgcagtgggtgcggaccgtacccgccacgatgccagatgatatgcatgagatggcgcagtcaatcgtcgacgagttcacgcgcaccgcacggcgtctgctcgaactcggactcggctatctcacgctcgaccgtgcgggctccacgctgtcgaccggcgaacgccagcgcatccagctcgcgcgagcggtgcgcagtgagctcaccggcgcgatgtacgtgctcgacgagccgtcgatcggcttgcatccggcgaatgtggacggtctgctcggcgtgatgcgcgatttgaaagcgcagggaaacactgtggtcgtcgtcgaccatgacacccgcgtgctgcgcgacaccgactggatcatcgaaatgggcccgggcgcgggatcacatggcggcactgtgatcgcgcagggtacggtgagtgacatcgaaggcaacccgcactcgctcatcgctccgttccttgcgagcgagcgtttgcagatcgtgcgcccgcaaacgcccgcgaacaaggtattcgacgaaggcgcactggaaatcaagaccgcgccgctgcacaccgtgcacgccttggatgcgcgcgtgccaaaacatcgtctcaccgtggtcaccggcgtctccggttccggcaagaccacgctcgtgctcgaaagccttgtgcccgcgctcactgcgaagattgccggcgaacgcctgcctgaacatgtgcgcgcgctcgatgcgccgggaatcgaccgcgtcacgatgatcgacgcgacgccgatcggtgcgaacgtgcgctccaccgtcgccacctacagcggtgtgctcgacgatttgcggcggctctatgcgcgcaccgatgcggcgaaggcgcgtggactcaaggcgggcgcgttctcgtacaacaccggctcgctgcgctgccctacctgcgatggcaccgggcagatcacactcgacgtgcagttcctgcccgacgtggacatcgactgcccggactgccacggcacacgctacggcgatgtcgcaggcgagatcacctggacgccgaagaacgggcacaagccggtgtcgctgccggatctgctcgcgatgacggtggacgaggcgctcgacatcttcaccggtaccgggcagcggcgcctgcatgccgaactcgagacattgcacgagctcggcatcgggtacctgacgttgggcgagagcacgccggcgctctcgggcggcgaagcgcagcggctcaaactcgccagcgagatgggccgcgcgcaggatggcacgctgttcgtgttcgacgagccgacgattggcttgcatccgcttgacgtgcgcacgttgatcggcgtgttccagaagctcatcgaccacggtgcgagcgtggtcgtgatcgaacacgacctcgacatgattgcgaacgccgactggatcatcgacatgggcccaggcggcggcgagaacggcggtgagatcgtcgccaccggtacgcctgtgcagattgctgagaatccgctcagcgtgaccggccgctatctcaagccctgcgtggagtgagtgccgttttcacggaggcgtccgtaagccgtgccgtttctgggtgcggtgatggcagattttgcggaagcctccgtgcgtttgactgcagtggaggttgtttgtggtcgttcttgcggacgcttccgaaagccgtgctgtagagagctcctgcggtggtcggtttctcggaagcttccgtgagatatgccgtagagggaggctgcggtggtcgtttacacggaagttaccgtgaatccgaccgaggaacaggtggtctgtggaaaatctgcggcactatgcatgcgaattcgatatgatgaggcgtacctgccgtgcaatcacgcggcgggacgggcgaagaaatggcagtgtggacatggattaccaaagtgagaatgcgcagacaatagaccgctgggttgacgagggttggcagtggggagtgccgatctcgcatgacgcattcgtggatgcgcagcacggcagctggaacattctgctcacgcccacgaaaccggtgccgcatgagtgggtcggcgatgtgcgcggcaaacgcgtgctgggattggcgagcggcggcgcgcagcagatgccggtcatggccgcgctcggtgcgcagtgcacggtgctcgactattcgtcacgccaatgcgagcgtgagtacgaagtcgcagatcgcgagggctacgacatcgaagtgattcaggcggatatgacgcagccgttgccgtttgcagatgagagcttcgacctgattatcaatccggtgtcgaattgctatatcgagcaggtgaagccggtgttccgcgaatgctaccgcgtgctcaagccgggcggttcgctcattggcggctacgacaacggcatcaactacatcttcgacaacgaggagaccacgctgacatatgcgctgccgtttaatccgctccacgacgagcgtgcgcggcagctgctgctcgacgaagacgccggcatgcagttctcgcacacgctcgacgaacagatcggcggccagctcgaagcgggattcacactgcgcgcgctgtatgaggacacgaacggggaggggaatctgcacgaacaccatgtgccgaccttcgtggccacgtggagtgtgaagccggcgaggtgagcgtgcgcgtgatcatggtagatcatggtatgagaggaatgccaggcgatggcggagtattcgggatcttcgggatatgcggaatatgagtatcttggaacagcaaacggcacgagctttgcgaaacgtcatccctacttgctgtggcagatcatcggctggagtattctgctcgcagatgccgtcttctttgtggtcgcggcactccaggacttcggcgaatggtgctacccggtcatcgtattcccattcattgcggcactgttcgcggtgatcggttcgccgttcctcatctacttctcacgcaaggcgaagattccgcaggccgcctccaaacgggaggcgagcgtggtgcgcagccacatcacgatgatctcccagatacgcggggaatcccaccccgtactgatggcgttgctgattattgcgctcgccctcggattgctggtgctcacactccagctcggcatgcgcggctatattctgcctggattcctcgccatggtggccatggtggtcgtgccgttcgtggtgtatgcgcagtattccgccgcgcagaggaagcggttcatggcagtgcccgatgccgcttaccttgtgggcgtgcactatgccgaccagtcgcgatacgaatcggtcgagctgcgcgagacggacgctctgatgatgccggtgcccgcaaaaccgagcaccgcgatgctggactttgtgtacaactggctgcgtgaatatctggccacagattggctgaccgtcaccgtgctctctttcgacgatctgctgcgttcgggagtcgtcgtcaacgactccgatacggaagacaccgaccccactgcgtcattcccgctgattcccgcacggcagttcaatctggacggcgatgcccgcgcgcagcttgacgaggaaagcaaggcaattggtgcgttctggctgtcgcgttggcgcgggtacacgcagatgtagcagatgcaaaggaagggccgggatctgcattgcagaccccggccacagagaagagaaggaagaagaagggattcagttgtgtcagtccgcgaatgcggttcggtttccttcgccgcgctccgtgagctggtgactccactatagacgcgcgcatcttggagaacggatgacgcatgctgaaggaaccctaggaatctgcgcaggattgccttggcgtgcggaatctgttagccaatggcgtgaagtggaatggcacgcctgtactgactgttaatagtgacaacagtgtgaaccaatcgcacatcgagtacaggaggtcggcatggcacagctcaccaatgaggaacgtatcgaagtgaacgacggtcgcgaaatgaaagtgctgatgatcgtcggatcgctgcgcaagaactcgttcaacaagcagcttgcggcaatggcggagcaggagctcggcgaccgcgcgtcggtgagcgtgcttgattggagcgaggtgccggtgttcaatcaggacgaggaattccccacgcccaagtcggtcgccgaggcgcgcgttgcggtgaacgaggcggatgcgatctggattttcacgcccgagtacaaccatagtgtgccggggtcgctgaagaatctgttcgactggctgtcgcgaccgctcgaagatggcacgccgtcagtgctcaccggcaaagtgatgacgatgagcggcgtgggcggtctgaacacgctgcggtacgcgttcgcggcgtggatgccctcgctcaccctgttcaaaatgcgcattgtgccggtgccgttcacgggcgtcacactcaaccgcgagatgttcagcaccgataagctcgaactgaacgcggcgatgcgcacgtcgctaaaataccaggccgacgccacgttgcaggcgattgccgaggccgagtagcggcagtcggcgcggcttgctttgcggccggttttgcggaagcttccgtgagccgtgccgcggattggtctgggaatggcatgtcttacgggagcttccgtgaaacacgccattcttcttgcgtaaaaggagacaattgacgcctagattttgactctttttacgcaggtgaaatctttcgataggtttctaagaacgatctgtgcatgcgccttaccttctcgcggcatgcgtattgatgtgcggttttattgacaaaacttttatatatataatcaaattggcagatttctatttgcttgagaaggtgattgcaatgaggcaatggcggggaatcgtcagcgtgatcgcggcgatggcgatgattgggggattcgcaggttgcggacagtcgcaggagcaggcagggttttcgaaatccccgcaaagctcgcagacggcgacaggcggagcaagcggggaaataggcaacatggaatcagagcatcatattcttcctagttccgatgttgaggaacttgagctcagattggaatcaatcggcgaatccacggcgacagggaatctgactttgcttggggagctgcatccgacggccagctacacggaacgcgatggcggtaggggcatgcccagtctacagaatcaggatgagctcacgttcagtgattgcaaatcgtacatgctcagcgtgttgtgcatgggtgagggcagtgtgagcatcgagtggacactcggaacgcaaagtgagcagcggaatctggaatgtgcgccgaagatagccgaaacggcattgggtatgagcaatgtgaatgcgaaaagcagcacggtgaaaattgtggcggaagagggatcgaaagcggagattgcctatcggctcgacgagattggcaaacccggcgtcgttgtcgactgactgagattggctcattctccggcgtgagatgtgtatggcgtttgtttgcgtaaaaagagtcggtgagaaagattatttgactctttttacgcagataaggaggtgcgctacgggttggggcatacagccgcggttctgtggtcgattacgcggatgcttccatgaatcaggtcgcgatgtgcgcattttgcggcatagattgcggatgtttccgtgagctgtgccgtagatatcgctttggcggccggttttgcggaagcgtccgtgagctgtgccgcagagtggtctgagaatgacgtatcttacggaagcttccgtacgttgtgccgtggaacggggtctgcgcggtcgtcccttcggatgtttccgtgagctgtgccgcagaatggtctgtgaatggcatatcttacggaagattccgtggaatgtgctgcggggaagtctgcagacgacatatcgttcggaagcttccgaaagacgagccacatctgcgtgacttggtggtcggttatgcggatgtttccgtgaaacgtgcctcgctggctcgggtaccgctcttcttgcagagcggacgactgggtgtgattttgactctgttatgtcgagaaaattcagagaggaagggaaatatagatacttgagaagatgggaagagcggtgaggaaatctgagaatgcgaaaggcgtgcctatgctgtttgcggaaccgaggagggcgacgagaatggcgaatatgggagattacgcagacatggatgcggaaaatgtggaatcggcggaggtggtgtgcccacggtgtggctcgcggcatgtggcgcagattctgcatggtatgcctgcgttcactgaggaactgcagcgtgagctcgctgagggcaaggtggtgctgggcggctgcgacatcgacattttccacccgacgccgagctatcactgcaatgattgcgaggaagagttctgatgtgcggggcagttggtgcgcggctgcggaacggcggcgaacgctaatctcccgaaatcgcttctgcgtaaaaagggacggtgggagctgtgttttgactcttcttgtgaagagaagatcgcacaggttccgcagacttcgctccatgtagttaagcgttcatgctgtggggcggtgtggtatgggcattcaggaagcattgcgcaaggcggccgagatgcaatcgcatctccagatcatctctgtggtggagtatggaccatactggattttcagctactgtgaaccaggtctaactccagaggagtgtcctggtatgcctatgttgaaaatgcggcgaacagatggtttcagcacctatctgcatgtgcaggacaaagacttcctggacattgtgaagcatgcgacaaaagtagatctgcccgagcatacactcccatattcgcctacttcctagaaacaacaggcttgtacagccactgcctagatgttgaaaacatggagaattcctcgcatagcattcacttcacggacaggttttgtgggcatgcctccaaaaatgcggtatctcctcgcaaggccccttccatggggcatgttttcgaactgcccgtattgacttggtaagtatgcttgtgccatggctctattcatgctgaatcatcatgtgcttgccgaagtcgcctatgattcgggtgcgcgcacctatgccgtggatttccccgaccgtcagccgtggttgccatctggtttctcctttcaggtttgcactgcttatacgcaggtggtttcctgcgaggattcggctgatacgacgatcccggcagatgagaagattcggcagatgctaaatgagcagattgagatatggcatcgggattggcagtgcacgggagagacttgggaatagtagtgtgagcatgcagtctggagatgacaggtccatgtactgctttccttgcgtaaatagggtcggcatagtgtcatgatctgactctatttacgcacccgggatgcggaacggcggacggagcgtgcgcgtttgtctcactccgctttcgcgctggagccgcggcttgcttccactgggtatttcttggcgtttttcgccattttgctgcggatgatctcgtcgaggtcgacgtcgagcacgtcggccatttggatgcagtagatcatcacgtcggcgagctcctcgtacacgtgctcccagtcgccgtcgcgtggctcgtcgctccactggaagcactcgagcagctcgcccgcttctatgctcacagattttgccatgttggcaggcgcgtggaattgttgccagtcgcggtctgcgctgaactggtggatcatgcggagcgtgtcatcggagatcatgggtgccatggtagcaaagctgctagtatgcgcagtatgagtatgcctacaacgtcgtcgcgcagcacatacatcgtgcatattcccgcatgtccaggcgagctggatgaggagacgctacattccattatcgagagccagttgaagcaatccattcctgctgattcggtggtggaacagcatgccagagagtatcttgagcagtatccggtcgtttacatcgtgcatgccgaggatgtcaagcagaggaaagactcttctgaaactcggtacatcgtgtacgttggcgagacaaatgacattgtttcgccaacgcggcagcatctcatcggcgatgcaaagaatgaaattcctacatatgcgcttaaggaagtctgagaaatagagttggctggcaaggaaaagattgatgtacgtatactgagatatacggagaatgggcagaaacgatacatggcggcatcttgccttcttgtcctaatcttaagcatcgttaatgcatatgtccatgaaatcgaatacatgctcagaaaaaaagaatataattattcttggagtgaattatataattactttatagatttttatccgaatgtcaattcgcccttttctttgctgcttgagctgttttctttcctgtctacccttgcgattgctcttgctgttgttgtggagggggaagggaagatgctgatattgagtaaattctcatactggctgtgtgtgggtagttgtagtgtgcttgcggttatgtctcgtgctctattttccggtctcggtgtgataaaggcaattgcggtaattgtttcctcaatcattattctttattatctaggtagatttagtattgtcattgggcaaaaaaactttatcaatgcaaggatggcttttgataaatcggtctcattgatttatttaaaactatacgaacgatacggaggggaaaggtctgcggcaagatcacttgtaaaagtttttgtattgctttctattttgcttataatggctataggtccttgggtgttgctgattacggatgccttatcggcgacgaggtatgataatggcaatattctatctgtcttgcttgtattcctgtttatttattgtctgacgtttgtagcattgttaaaaaatgaagaacatgggatgaatgggctacttcttgtgacgagctgtttcgtacccctcttgcctctcctgttttatgtattccatagcattcataatagtattcattatgtaattatattttttattgcattatcgcttagtttctggtcattgttctgcgttgcttgttcgcgtatgtctagcggggagttgtcggagaagcttcgaaagcgtcgtccttggatacttgttgctgaaattgaatctattcattctataaaagcaagactatatatgaaaatacatttaaaatatatagatagagttgagtatatgaatggtcttggtggtagttgatattgctgttatgtgttatgttttgggtaagcaaggtggtgttgaaggtgctatgaatatgccaacatgccggttgttgaaagtggtggtaatttgcggctgatgcagaatttttgaattgtggtattgagggcatgtttttgagtggggctaaacgcgcgttctggtgccgatacgtgctgtcgtccaaatattcgaaaatctcaaaagtgttgacgaattatctcgtatttttgttttgctgggattgtattttgattgtcggcgttagggtcgtcatcggcgttggctggttttgcttatatgcttatgtcgcgtactcgagtatggtcatgctggtctgattgatgaatcttgctggcagtttcgatgtgtttgcgtttgtggtcgtgcaaggtggttccctggctcggcgttcgtgctgctgtgtcggatttggcgcccgtttgtttacttcattggtttctggtagactgaagtattgcgggaaaattgacattctttccagttttttccatgtgccgccttgcgacttcaattcttaattgagcgcaaatagttttgagctcgtgggtgagggcggaattaattaggtataggagtcgatggttgtgaggtggtagctgcatgagcaattcggtcttggtgtagcgatggttggcgtgtgaacttaactattggcaagtgtattgcgacgatgccgcgtgtgttcaattgtgagttgagtctcgagcatggtgtgagacgggattgcgctattgttctcgcctccaaggttctagtggtatatggaatcaccgaaagtactcattttgtagtccctgttaaactatatgattggggtatgtcggaaaacgcgctgctgaacactaaggaaacagcccaatatataggggtgtctgcgggtgtagtgacacgtctcgcgaatacgggcgaacttgagtttgacacctgcggagctcgtaaagttttccgtaaagaagccatcgacgcatatctggaacggaataatctgattcaagctgcggtggatcaagtgtcaactaaagacttcgaggacaacatctgcgctctctcatttttcagtggggctggcggtctggatcttggctttgagcgagctggcatatcggcggcactatattgtgagaacaatcgtgaatgccgtatgaccttgcatcgaaaccgtccagatgtcgccctgctcggagatatcaccaaaatcagtgccgacgaggttcgtcgaatggcccgtatccctcaggggcgtgaaatcgatgtgatgttcggcggtccgccatgccaagcattttcaacagcaggcgcgcgccgtgcattcgaggatccccgcggcaatgtatttctcagatacttggacttggcctccgaattgaagccgcgatacctagtcatagaaaacgtacgcggactgctctccaccccttttcccgttgaatctggcgggaagccaatccggggcggagtgatgcgctacatactcaataagttggaagagatgggctacggtgtttcgttcaatctctacaacgcggctaactttggagcggcccagattcgtgagcgtgtggtcattattgccaaacgtgatggcacgaagtgtgactggctcatacctacgcatactgatcctgatggcaaatatgtccaaaactggaatcttccctcttgggtaacgttccgagacgttgtctacgatattgaagattctcggcaaacccacactgatttccctgagaagcggttgctttacttcagcatgctgaaagaggggcagtgctggaacaaactccccatcgaaattcaagaggaggctatgggtaaggcctataagcttggaggcggcaagaccggattctaccgacgcatcgcttgggatagaccatcccccactctggtcaccagcccaacgatgccagccaccgacctttgccatcccaaggagctgcgaccgctgagcgtggaagaatataaacgggtgcagggtttccctgatgattggtggattgctggcagcattcacgaccagtaccgccaaatcggcaacgccgttccggtcagcttgggcgaagcaattggccgagcaattctcgatgacatgaggggagaggctcatgatgagcgttggcgcaatttcccctattcaagatatgcccataccagcgatcaaaactggaatctggcctgaatagtaggatttagtgatcttaaattatcaattatggaggcgcgcaaatcaaatcaatgatttgcacgcctccattggaatctgcgaaagtcctttatctgccagtattcctggcgttcctcttggcttcgcgttcacggcgtttcgcctctttttcggccttgtatctgtcagagagctcggcaacaccgtcgagtgtatgtggaagaccattcttatcgagctcctccagcagttgcgttgttactcgctcgagtgatgattcacgagccagaagcacggcttcagagttgatacttgagaatgggcgaataaggccatacggtgagtcaatgccgcacagccactgccacattgcagtgcccgacagatagcggtaacgaaaattcttgagatcggcgttctcctgagtcactccgctcacctcgaacgtacgccattcgtctttactgatagtcgaacgcgtgatgcagattgctgcctccactctctgattcgaagcacgtttacggcccgtaatctccttcatgcgttgacgtaaactcctcaattcattggggaacgacgatgaattggtcgtgttctcttgtgacttgagttcaatcacatagaccgctccatctctggtcgcggtcaaatcacccgtatcaatagcgttttcggcaatgctggcaatcaactcctgccaacgggtacccattgccgtctcttcgcttgaagattcgactgcgtggaaagcctcacgcgcatagtcttcagcggtttcaataccacgcagagcataaattgcaaaatccttgcccagcaaacgctcataggtcattgaggagcttcccgtgccatcgtaaaaagcgattcgactctgaatgtaggcatttagaatggagcgggcgctttctctacgtgcttcttcctcggctgcgctgtcgtaaattctcacttgatcttccatatggattaaccgtagtgtgcgtatcctgcatatgcaaatctttatgagactgtgtaatgtctgtcgcaggatttcaggctgaaatgcgtatttcatgtgtttgtgccgaattgttgactaagattttgaagcggtgtaaaaatcctggtttcttgtgccatgagacaccctgattacgtttcaaatgttggtgtcagcgtcgtagccggcatcggttgtttttgagtatatgctcatgctgtggactcgagcgcgatcatgatgatttggtcggcccgacattgcatctcggaagtgatctcgacgcggtgcgtatgtccttggcgttcatgaaccggcggatcgtccagcccccgttcatgtcgacgaggacggcacccactaggcacagaagggtgtatgtgttcaattaggaattgaggttatgaggtgatgcaagaaagttggattctgtagcgggaaaggaatctaacttccccgcaactgcttcttctctacctcaatgtgagccatacgctaaaatgcaacgtatgtctcaaaggtgaggagaatcgcatgggcagtggagaattgcagacgtggaatggacacttcgataggggagtgtacatcgattacactctcgagcctttgcaatccgagcgtcacatagaaggcaccaaagatgaagcctcgcagtccggaagccgaattgatgaagatacaacgatcgaaatagaggatatcgaggaagaaaacaatagcgatcaggatgaatctcatcgtgtggattacatgcttgctgccggctgtggaatcatctctggcgctattgactcattgtgggtggggaagtttgatttcgatcgcgctcgcgaatggggaagcgagcgtgtcaatgagtttgtgatggcagtcgcgaagatggatccagagtataaaggcgatgacgtaaagtcggcaattcgttttctagagaagaagtatccatttgtgggagatcgtgcaacaagtgagttcggtggtggtcgtcagcatcatctcagggatttctcgcatcacatgagcttgggtggtcttgcgttttcattgctgacgcagttcaccggaaaggtgtatggcaccgatcagcacggtgtctttatggtcgtgcctgttgcagatgaggagctcatcgggaaaactatagaagagaagctcatgctcggtgctgtgcgttggttcttccatatggtgagcgatatggcgggttcgagtggatcagcggggaaggggaccggtattccagggccgatactttcgttgatgaagcagctatccgcgcttcctctgttcaaggatgcgatgactgatgaggcgttattcaggaagatgctgtccaaactgttcaacggaacgttgctcaagaccgtcgacgaagaaggaaagaaaatctaccgacgcttcgatttgcgagcggaattgggaatcgcgcatgaacttgctaggcagtcggtgccggtgctggtcaacgaatgccttgtctgcgtatgctatgcagcccggcgactgtatacaatgtgctcgaacggggaagtgcatgatttcaagtcattgctgagcgttgggcttgacgcattgttgccacacggttcgccattgggtacgcggatggtcaccatagcgactggggtgttctctgttgtcgatatgacggatggggcgattcgcacgctgatgcgtagcggagggaagctcaatccgggaatggtgtcggatttcctgctacatgtaaatgtggtgggcgtcgtgcgattcgtcttcgccgtgcatacggattacaaggtacatgcgaaagcgaagagagagactcgtttgcaggcaaagtttcacgggcgaggaaacggctatggcgatgatgcctcggtcatgcgattcttcgagctggatatggcgcaggcgaatatggtggtttccattgagtatcaggcagctcgcctcgacattgaacagacgaagaacaagaagacaagagaggagaaggaacgggagttcagcgattgggagaacgataattgctctgaattcatattgcgcgacaaagaagcactcgtaaatgaaattcatcgaattcagaggtatgctactccagtctggcagaaactcgtggcattggaagcttctcagttcatgccgtatcagagcaagaaattgaaatacgatgcggcgacgctggatatggtgtgcagtgatctgccggggtttgaagataaggaatgcaccaaatacagaaaagctgtgattaaggagacgtcggcaatcaaaggtgtgaagaaagcggttctagccggttgtgtcggaatcggggttgtagctgttgcgacgggaggggctgcttatgtgttcgcaccggcgattgcgccaatcctagctggaccttctgtggccggattgtcgggagctgctttgacgagcgcaagtcttgctgcggtgggaggcggctcgctggcggcaggtggtcttggaatgtcgggaggcgtagccctcattgcaggaggtggcgcattgctgggggctgttactggcggtggcgcggcaacgttgggcacttgggtgcttgcaaatcaagacgcatacgtgctgaacacctgcgcaaaactgatagtgttctgcagggatgtactgatggaaatcgacggtggtgtggaactcgtgcgtcaggtgcggcagagtgtgtgcgagcagctacgggaaactgagcctcagcttgacttcttggggcagctcaagcagttcataaagcaaagcggtagcagagatgcggattcggatcctagcgctaaacgcgaacgttctgaggcgctgaagggaatcgacaaaagtgaaaagaatatgaagagaagcgtgaaatacatgcggaaatgcgtgaaagagctcggaaaggtcacaggaatcacagatgagaataggggtgcatctggggctcaatggaagccggtagctcagattgagaaaggctgatgagctgagtcaggtggcagccctgtctcaacgcaatgcgttactggcttcttgccattttgccaggaacagcagctcgtcacggtaagggagctcccagccaatcatatccggatcaaacccgacgatgccgttgtgtttgcttactccggcaaatacaacggcatcggaaagaacgcaaccttcccaatcctgtaccgtcagatcacgtaatcccagctgcgcgatcacaaacgtgccgccgctgtacggaatcctaaggtcatgtggcttggtgcaccgcaacatgccctcgctggtttccgccagatctccaatagctgtcaaagctgagcagtattggtgaatcagggctggcgtaaacttgcttcgcagctgcggatacagggcgctcatctgcttgatccatgccaaggatttctgctccaccgcggtctgcgcgatgccagctgcccctccatagccgtcatcaatgcaatacgcctgcatccagaaccgcaacgctgtgaatgtgcaacgacatgccaacgcttccccgtcagggtcatcggacgcccgtcgtggcactcccaagtcatgtgccatcacatcaacgagcctgcgaaccatggtcaatcctgtcgatgagtgcggcgagttgagccgcaatggttttattggtcggttcctggctcaattcgtgggctttttccgctccttggtattcatatgtttcaatgcataggtgcggcatgatccattgacgtgctgatgcagtgtcctgtgcaatcgccgtgatggcggatggcgtcaccaatgcgttctgcggaatggaagtcattcttcggaggatgtccatttgcgccagtatcgatcttgaagttatgtcgattcgcttgagcgcttcctgcgcatgatgcagcggcttatctgaagccgaaagctccaccatcccagtcgttggcacatagaacaccttgttccacacttcaggtgccaaaagacgtatattcgcaaaactgccgatcggtagaatcactactgatttcgcaggactatatcggttcaatgcgaacagcagactttcattgacggtgtcgaacacgttatccagcacaatcaccggcgactcagagtgctcaagaaactcttccagcatcgtgaaatcactgaaatcgattggaattccagtatgctgtgctggtgtgccggcgagcgcgaaggctagcgtattggcgatggtcggcacatggacggtatcgaccgctagcaatcgcgttgtgcgcagtgtacggcagagatgagcggcgaaatgcgtgattcgttcattgttcctgttgctctgtccggtgaaggtgcagcctagtatctgcatattctgcgccactgcctgttgcatatctgttgctgcttgtgttttcgctggtcccatcatgggggccatgcgaagttgtctggaggaatctggcgcagtcgagtgccgtatagtcaattcctccatcatggaatgattctgctgggcaatctgctgcaagccgagcttgagtgccacattattctccagatcctgcagcgctttatgttgttcctctttctgcaactccaactctgcctgtgcatcgcgtatctcaccacgtttgcgctgcaattgttgattgagctccgccaactgtgcagttgcttgttccgccttttctgattcctcatcccgctgggcccgcagttcatccagctgcttgcataatacttgcttgtgcttctcgaattcgtcatcgagctgcgcagtggcttgcttccggaattctgccattacgtcgtcgtcgtttttcagcacatcgtagatgatctcagacacatcgtcggtattgctgcgaatggttgctttgattgccgtttgaagtgcccggacatcgttatgtgagggtttggcaccgaggtactcttcaagattcgccggtttctcgaatgcctgttccagaacatctccggctgtgcgcatgagctcgtcaccattcatcgcatgctctttgcggatgtaccagttcacgtacaactgcgccagatctcgcataggcttgatcactacttgagagtgagacttcagttgtgtcggcagattgtataccagacggtcacctctattgaaaccctgattgatgattcgcacatgacggcgatccaggatgacgcgtgggacgctgttcggtgctgtgttgctcagtgtgagcaagccattatgaatcgttgtcatactgcggtcgaggacggccgcgtccaacatattgttattctctgcgaacaatagcaggattttcgcggtgggacggccggaatactgtatgccttgcgaaagcacgtcaggtagctcttccgcacgattggccgggcaatcaatcacctcatacagcggaggctcggtggttcgtaggccaccttgaaagatctcaacaaacggatgatctggacgattgtaattcggtgtccactggagaaacttgaaatccgagtcactcttgaccatgatttgcgtgagttttgggttgtatagggtcttcgggtcaagagggtcatctgaagacgggttcctggaccgttcccaccagcgcggataagccacccaatcataacatccgttccccgcggaatcggtcacgtaatcgatgatgcgtatgaattgtccgtcaccattgtcgttccagacaaagagaccccaggactgccgagattcgttgaattgctgtgacatctgcttctcccaaagtgatgagtgtgttaacggtacgtggaacgtatgcgggcaagtgagacactgagtggtatgccatggtgttgaggctgttcgagtctcctctgctctatgtcgagatgtttattgagtgtctgacactgtgtctgctttattgccaattcgggcatcagagcagtggaggaggcgtgtggctgctcatcagatgaaggcagatgaggggcatctgccaacatgagtccttcagggtatgtgtgtgagagcacgtaagcactccatggtaaataccgattcgcacgcaggaaacagcattcgccctctatctgtgagcggactcggccatgtggggcaaaaccaagcaaaccaacacgtcgtggattgagatgatcacagttgagacgcggaaaatcaatgtcatcgtgtacgggattttcgttgcgggatgcaaatggtgtctggtatatctgctgactattcgagaacaagggttcgtctatgccgttagaacgcagttggggaggccaaacgggaacggggtcgagatcaagactggtgagtcggaaaccgtgatctgcaagccagaaatcagcttgtgtacgattcagcgaattccacagcgtgacgatgcgcaccacgagaagattgccgtgcgacgagttgatttcgccgatgggaacggctatgtcgaaacagctctgaagagcacgtagaatgctggggcgtgcaaccacatagtaatcaaacccggcgtggagagaagccccataggaaagtctacggcctccattcgggccgaattccgaggtgaagatgaacgcctgttcgccgtcttcgggactgcccacattcctctgccactgttccgggacggaaatgcgtgcacgtaatccgaaggagggattctccaggtgaatggtgtatttgcggtcggacacaagatcggcaagattgtgggagatcccgtctacagtgagtgtagcgcgatctttgcgcagttcggagatgagatcatgcccgagtgatcgacgacgaaccgatatctccaaatgaaaagtgggcgtgctttgtgcgtggtggccgctccctgctcggttgcggtctttgcgcaggaacatcggtagagaggggacgataatacgtgggtcagcccctaaacccgcttgataccgttcgcagaatctggcgactgggtcgttcttcgcatgccggaagtgcggccgtacagttcggtgaacagaacgagatgagtggctccgtggatttctgcgaactgcgggagcttggtccccagatgcgtccgcagatgttgtagacgctcgactgccgcggtggaattgcactggtcggtcgcacgatgggcagcggaatttcactcctgcaggtatatctccttggaagtcatgtactacttgatctgcggtaaccgtgcatacgggcgccatgggaatgaactgccgtgcggtatccattgatgccccctctcgtcctcctcgccgattgattccagtgtacgcggaaaatgcagtggcgggccactatttttacaatgtcgttctgtggattttcgcgtagtgtctgtgagcgctggcgggtgagtcgtatatgctacgctgactcagctcgatgtcagattctctgtcgcattgcgcaatctcgacgaggttatcgccgctcagggcgaggattacgcgcagttcgaccagcaagccaagcagtcggtcgccgcgtgcgcatcgcttgccatgtccatcaaatccgtgctcgatacgcccattcttgacgaatcgggcgctctcaccgatgagtccggtacgctgatgcgcgggtttgacggcaatcctgagtgattcaccgctaatgccgccgactacttcgcgcagcccgacatgatggtgctccggttttgccagtgagatatctgtagccagaatctcccataactatagatatccgattatcggcagcctttcctgcgtaaaaagggacatctgagggcgtctatttgactctttttacgcagaaaggcagaaagaaggcggagcgagggcaaagtaaagagagggaaagtgggtattgtcatctgcttcgacggtgatgccgccatgaccgattatgtaccgaacagttcgtcgtgggaaccggtgtgctcaaagaaggcgactttgccgttgcaagaccaaatgaccggcccatcgccggcgttcgccacatggcattcgtttcgtccctgccactttccggcgagtgtatgcatattatgcctttgtttgagcaccgcaatggatgcaggggagttctcgatcaccagttcgatgacctccttgagcttggaaggtcccactgtcgtttctgtgccttcttcttgagatctcggctgaatgccgttgagaagtccgcgctgagtcgtgccatcagttaagggctgccttgatcagcgattcggcgttgctgaagcgcccctcttgaccgctggcaaggaaggcgtctccttctgcaatggcctgcatgctttcggtattcggttcctcgtgggcattgtgcgcgttgcagctggcgaacatgaagtatatacttgtatctactgaaaggagtggccatgacaatgctgacactgagcaagtggggcaatgcgcaggcggttcgcttgcccaaggcgatgcgcgagcaggtcgggatgcccgatgattcgcagattgaggcaaccgtcgaaaacggtgcgattgtgctcaagcccgcgcggtcggcaaagcgcgcgattcgtgtcgcgaatcttgcttcggttttcaaggatcgcaaggagccctaccgggcctgcgaagatgatttcggtgctccagcggggaatgagggtctgtgatatgtgccattacggcgatgtgttgatggttgacctcgacccatccaaggggcatgagcagcgcaagcgcagacctgtggttgtggtgagcaatgatgccttcaaccggaactgcaccctcactgttgttgcggctatttcccatggccggggcgattttgagctgcacatacccttttcccctgttccggcgtccgatgtgtcaaatggtgggagcggtgtggcggatggattcgtgcagttggagcagatccgggcgctcgatctctctgccaggaacgctgtgaagatcggatcgctcaggcagaaggatatggatacggtcacatccatgctgctagggtgcttcatccagcctgacatgatggtgcttccgtcatactgacaacagtcctctttacgtaaaaaaggacatctgagtgcgtctatttgactctttttacgcaaaggaagggaagagaggggggaaagactgcttgctgtccgcgtgctggtcaaagcggcatatctcacggtgatttccgcgaactatgccgcgcaagaaacaccaccgcgcacattcacgcctccgctcactgctcccgcggccgatgctgggccaggtactgctggattggcagggcgagccgccggttgtcgcccaggaacgtggcgtagaagtcgatgcgattggcggggtcggcaatgctcaccgccgtgcgcgtgtgcggcatgaaccgttcgtcggtcatgcgcagcgatctcgtgagattggagtagaagaacgggaacgccgagtatttgctgatctgttcgagcgcgctcaggtcctgctggtacaggaagtgcgcgccgggaatctgctcctctatgaccgctcgccacgggcctatgtcgtgcgcgaccacgaaatccatgccggcgaggtcggcgaaggtgacgctcgtgcgctgggcgagcggattgaaattgtcaatcgccacgccaaggtattcctcgcccaagtacagtgattccacgcgcgggtcgtccacttcgcggtcggtgatgatcatcgtctccttgcgcagcagcaggtcgtcgagcaccgcgtcgggctcaatgagactgtgccgcacggtgatggacgattcccatttggcattgcgctcgccggcttgctcgagaaaatgcaggggacccggtgccacggatccgacgacgatctcgttgtgcagattcgcgtcgttccgcacggtctcgacgaaccggtcgtaggcgtcgagcagttgctcggcttcctgtgcggcgagctcgccggtgtgggtgagtgaaagccggttcttggcgcgccggtcgaacagcgggacgccgagctcgcgttccagtttgcgcatcgtgcgcgtcatggtcggctgagtgatgcgcagttcgtctgcggccgcgctcaatgtgccgtattcgcggaaggcgacgagttcgcgcagtgcttccaattcggtcatatcgctccgttcgtcttcgagaccgagcccactatgcagattgcgcatagcaagataaatgataggcattgtacttcgccgaacaacggctttacgattctgggtgaacacggaaaacgtgaatagacatgataggagaactcatgcagtacgtcactttgaacgatggaaacaagatgccgcagctcggattcggtgtgtttcaggtgccggatctggccgtgtgcgagcaggccgtctccgatgccctggagaccggctaccgactgatcgatacggccgccgcatatgcgaacgaggaggcggtcggtgcggcgatcgcgaagagctcggtcccgcgcgaagacatttttcgtgacctccaagctgtgggtcgaccacttcacgtatgagaaggcgaagcagggcatcgatgattcgctgcgcaagctcgggctggattatctcgatctctacctgctccaccagccgtacggcgacgtcgccggcgcatggcgcgcgctcgaggaggctcagcaggcgggtaagattcgctcgattggcgtttctaacttcgcgccggaccagctgatcaatctggagctcatgagcaatgtgaagcccgccgtcaaccagatcgaggtctccccgtggtatcaggagaaggatgaagtgcgcttcgcccaggagcaggacgtgcaggtcgaggcctgggcgccgttcgcggagggcaagcatcacatcttcaccgacccgaccatcgcggcgatcggcgagaagtacggcaagacgaacggccaggtgattctgcgctggctgctgcagcgcggcatcgtcgccattccgaagtcggtgcacaaggagcgcatggccgagaacttcgacgtcttcgacttcgagctcagcgacgaggacatggccacgatggccagcctcgacaagcacgagagccagttcttcgatcaccgcgatccgacggccatcgtgagcatcttcggccagagcctgcgcgcgctgcgctcctgaacggtatatatccgcgactttgccaagtgaggaacgtggtggtgcgggacgttgccatgctgacgcccaacgccaccacgtttcacgtgaatcattggttgctggcgttgtagagacccatgatgcgttcgcagagacggccggctgcagaccccagcagaacgttggtggcgttcattggcatactgccgagcagcatacggagcatgtcgctttcgggaatgatgggatgcccctcctgctgcgacagccggttgatcgcggcctgcagtatcgggccgcctatcgggtcgtcgctccattcgtcgaaggtggaggagagcgtcaacggcaggcgtatgccgtcaccgggcagttcgacctgcactcgttcggcgatgtcacgtgatgacgaaccgatctcaatggtgtaggtgccccgttccacatgccagtcgttcctcggctcggaccagtaggcgaacgacctgctgtcgagctcgaatgtgacgatgctggcctcgcccgggtcgagtgtgatcttctcgaatcctttgagctcgtgggcgggccgggcggcatcacaggcgcatggcgcaacatacagctgcacgacttccgaggcgcgcacctgaccggtgttcgtgacgatggcgctcacctgcacggtattgtcatgcgggattgcactgaggttgcgaatctcgaaggtggagtaggtcatgccgtatccgaacgggtatgccacctgcctgccgaaggtgtcgtagtatcggtagcccacgaacacgccttcgccgtaatccacatgccctgcctccccgggccagttgggcatgctcggatcgtcgagcacgctcatcgggatggtctgcgcgagtttgctagaggggctcacatcgccgaagatgacatcggcgagcgcattgccgccctcctgcccgagcagccacccctccaacaggcccctgaccgaatctcgccacggtgtgactgagacggccgatccgtttgacagcacgaccaccacgttggggttgactttcacaatgtcggcaagcagtcgcagctgtttttggggcaggtcgatggtctcgcggtcgaagccctccgattccgcttcctcagggagtcctgcgaagaacagcaccacatcgttgcgccatgccatgtcgattgcatgggcggtgagcgcggcgtcctgcttggcatcgtccaaggtgaagccgggggagaagtccacgggaatgtcgcgaatatgcaggctgccgaggaacgacgagacataggtcggggtgagtttggacgatccccctccctgataccgcggtgtgcgtgcgaattcgccaatgacggctatggagacggaaccgtcggcggccaatgggagaatcccgccatcgttcttgagcagcaccatggattcctgtgcggcacgccgtgcgatggcaccgtgattcaccagatcgtaggggtgatcgtcctgctgcattgcaggagcagccttttctatgaggtcgagcatcccctgtgccatgcggtcaagttggtcctcatccaacaaaccgtcgcgtaccgccacgaccacctgttcgtctgtgttcgtgggcggcatctcaagattcagtccggctttgagcgcctccacgcgatcgtgcacggcaccccagtcgctgatcaccacgccgtcgaacccccattcgtcgcgtaggaccttggtgagcagccatgagttctgcgaacacggcgtgccgttgagctgattgtaggcgcacatgaccgtccaaggatgggctttggtcacaatgtgctcgaatgccggcagatagacttcacgcaaggcccgttcgcttacccgcgcgtcgatgcgcatgcggtcggtctcctggttgttcgccgcgaaatgcttcagcgacgtgcccactccggtgctttgcaccccctcgactatgcctatggcctcatgcccggcgaaatacgggtcttcggaccagaattcgaacgaacggcctccgagtgggttccttttgatgttcacgcccggcccgagcagcacggccaccttctcctgcacgcattcctcgccgatcgccacaccgacctcgcgcacgagtcccgggttccaactgctcgccatacccgctgccggcgggaagcatgtggccggcatggaatgctcgatatccattgatgtgctctgcgcggccttgcgcagaccatgcgggccatcggtgatcatatacgaggtgctctcgctcaggccgttcagatgccacgcatccgcgcccgaggtgagcgccgccctcttctcgaggggcagttcgtgtgctggtgtcgtgttctgctgggatgcgtggggcattcgactcctttcgtgcgcgtcggggacgggcaactgtgtgcacgtgcgcggcattgcgtaatgcgggcatgaaaatgaacgaagacgggcttcgtgaatgaaaatatcgtagatgcgcgcattgtcgcactgcaaggggtgaataacggtgaaatgcttagatatattcgccgatttcgtccgctgctcattccgcttgcatgggcacggtgcctagccgaagctttcgattgcgccaatcaattcgagcttgtcctgatccacgcgatcacgcccgtacgcatcgaggaaccggtcgcgatatgcgtcggtatgcagattgaattgcagtgtccagattccccagaatatgtcgacgtgccggtctgagaacccggcatggtcgaggtcgatgaaaccggcgagacgccaatcgtcgagcatgatgttcggcagacagtagtcgccgtgaatcagcgcgtccgaatgcagagtttcgggccgctcggcgatgatgcgccgggcgtcgtcctgcgaaaggccgcagaattgcgcgtcgaaacggccggtatgcactccgtgctcggcattggcgagatagtctgcgagcacatcgggaatggcgagtgtcgcgacctgctcgtgcttggtgtgcggcagctcgtggagttcccgcagcaaagtggccgatgtgtcgcatagccgctgcgggttggcgagatggcgttccgcggtgcagtcttcgccgcgaaccgcgcgtgtgagcagccaatccgcctacgattcgcttccgggtaggtattcgagcacttccgggccgatgccgagcatatggaatgtgtcgtccatgcgcgcttcgtgcgcgagcgtgccgctcgccgcggttttgaggaacaggtcgggacgggcgttttcgcgggtgccgcctgagagggcgtagacgcgcgcctcgggggaggagctgctgtcgtacagtcggcgccctgccgtgtagtgcctcagttgggctggcagattgggaatgctctcgatcggtgtgtgctgcatatgctgaatatagccgatggcgcgtcctgtggcagattaggcagcggaactgccggaaaaggaaaaatgagcgaaaatcgtgcgcctgcttggggaatgccccgtacgctgggggaagatcttacggttcacgtatgcgaaggcgatgtgtatccggacgatctgaacacgagcagtgagagaacgggagagacatatgacttacgcgacgccgcccatgcagggaacacccatgccggcgccacctgtgcaacagatgcgtccgaatgcctaccggctgcccacgaaccgttcgctgacgaagttcattctgcttggtctgatcacctttggcatctacgacatcgtgatcatgaccactacggccgaggcgctcaataccatcgccagcccacgcgacggcaagaagacgatgaactactgcctgatgtacttcctcatcggttggctcacgcttggcattggctggctggtgtggttccataatttcagtgaccgcatcggcgaggaacagcggaggcggggcatggtgccgactgtcacggcaagcactttctggctgtgggaggtgctcggttcgctgattgtggtggggccgttcatctaccactacaaaatgctgcatgcaatgaacgatctgtgtgcgtcatataacgcctatggcatctgacctctgattgaagcagactgggtttgggcgcggattccgcgcccatttttggcgattggcgaccgattgtcggtttcgtttggtggatctgtcgcattgtcggctgggtaatgctccccgcaaagttatctacctatagttcaataaatgatatagtgtccctatgcaacgtcgatgttgcatgaagaaatgcgaccattccaatcaaaatgacttgaagagactagtgaactacagttcactagtcttgtgtttggtgcattggtgcgccggtgtaacgggagtggttgcaggcatatgggaagcaaacataaggggctcttctcaggttagtgtgtaaggatgtctttgagttggctgctgtggatgaggcatcgttggatgtagctggtggtgttggcgaagcccatggcgttgccgcgcagggtctcgagcctgccgttgatggcttcggtgggtccgttgcttgagcgggggtggcggaagagggcgaggatgtcgcgcatgcgtcttttgagcacgcggccgagggaggcgagttcccggcagcctttgtagcgccccggtccggtcaggtcgtcgatcagctcgcgcatcatgcgttcgccgcgtcgcctgtcgtcgcaccggtaggcgtgtatgaccctttggtaggcgtcgtgggcgagcatgaggtcgcggttggcctggatggcgaacagggccatgagtctggcacggccgcgtgcgccgaggtattcgtcgctggtcagcagggcgcgcctgcagtcgtagagcctgtcgcccttgacaccgcgcctgccggtggcgtcgcgttgcaggcggcagcgcaccttggtgacgcgggcggcggccagttgcacgacgtggaacgggtcgatgacctcgaccgcgtggggcacgacggattcgacggcctgcttccagccggcgaacgcgtccatggcgaccaccccgacgcgtcttgtgaactcgccgccgcgcgcctgcatccattcgcgaagcacctgggcggaacggcccggcaccatgtccagcagtcttgccggcctgccgtcgcaacgcggggtcaggtcgacgatcacggtcacgtaccggtcgccgaacgcgccgtggcgccacacgtgctcgtccacgccgatcgcgcgcaccgaggagaaccggtcggcctgctcgagcaacagcatgccccgctcgcgcaccgcccggtcgaccaccgcccatgccacatgaagcagcctggcgcacgccgagaccgtcatcgagtccaggcacacgcgccgcagcgcccacatcaccgccggcacgctcaacacgcccctgccggcgcccaccgcctcaagatcatcgctccacgagcgtgagcacggcacgcactcgtagcggcgcacgcgcaccggcagatgcaccgcgtcgtcgccgtagggcacatgcgccagcgtgcgcagccacgacgaacgcaccctggcatacgcgccgcacgaggggcaccagcgcgcgtcgtgcgagtccggctcgcacctgatctgccttaaccccgggccgtccggcctgccaagacgccgccacgagagcacacgaagacccatctcatccaaaccaaggaaacgttgggggtcgaacacgctaaactcgggttcaggccgtgtttcctcattcaatttctctatcacacaagcaatgatgaagcacggcccttacacactaacttgagaagagccacataaggagggcatgatgaaggcgctcaagaccactgtgcactacgatgtgaccgccgggcgaacccataccgagcagacggagctctcggtcatggacgaggcgatgaacaccgagcacatcgtcgaatcgaatgtggtgggaatctacccggactacacgttccagatgatggagggctatggttgctcgctcaccgagtcggcatgctatctgctctccaaaatggactccgcgacgcgcaaagaggccttggcccaatggttcggtcccgctggaatggacgcttggttcgtccgcgtacacatcgactcctgtgattactcgctcagtgagtaccaggccgttgaggatcctctggccgatcccgaattggagaccttctcgattgaccgtgatcgtcagtacattcttccggtgctcaaagaggcgatggccatggcggggcatcccattcatgtgttgctctccccatggtcgcctccggcgcaatggaagacgcccccggagatgacgcggaacgacgcctcggtgtacggcggcgaggagggcgatgtcatcgatctgagcaagccggggcgctgtttcggcggaaggctcaagccggaatactattcgtcgtgggcgcggtacctcgtcagattcatcagcgcctatatggccgaaggtgttccggtgacgatgctgtcgattcagaacgaggcggctgcggccacgagttgggatagctgcctgtggaccggagatcaggagcgcgaattcctgaagcaccatctctacccggcaatggaggaggccggtctgaccgatgccgtgaagatcttcatctgggatcataacaaggaacgtgcaatcgaacacatcgacgagttcatgagcgacccggaggcggcgaaggaggttggcggtttcgcttatcactggtactccggcgaccatttcgaggcgctgtcgatgttgcgaggcaagtatcccgacaaggtgctgatgcattccgaaagctgtgggctgcatatacccggcaaggtgaccatgctcgatatgaccgatgaacagatcgaggcgctgcccgatggcgactacaagaccatggtgcagacgaccactccgaacgagatggacttcaatgatgcgacggcctatgcccacgacatcatcggcgacctgaaccatggaatgcagcggtggatcgactggaacatgatcgtcgacaggcagggtggtccccgtcataccccagggggtttcgccgcgccgatcgtcgccgaagacgacggacggtatacgctgaccatcagctaccggtatattcgcgagattgcacaggccatcaaaccgaatgcggtggttctcggcacaagcacgtattcgcgtgatatcgaggcggtctcggcccgcaacgcagatggctcaatcggcgtcgtcctccttaatcaggcggagcgcgatatcccggtgaacattcgcatgggcggcctgcttgtggcggatgtgccgttgccggcacgcaccttgagtactctggtgttcacggagtgatcgtggatcgtcgtcgcacacgtgttgccgatatggttgcgccaccggcccaaaggccggtggcgcaaccatatcgatcgctcccgtctgctcgacgcatcggattcggtcgagcggaggcagattcaattcattgtgggttgccggccgacaatgatgtccactccccaacgcggcaatgtgacggcatcgcccacggtcaccggagtttcggcggtgacggcctgctctccgtcgtctgtgggatgtcccagcaggaacgttcccgaggcgggtgcccggaaggtgatgggcgaccctgaatagttgagcaggtaggtaacggtatcgcctgccgtgttggttccgctccgcacgcagactgtgccggccagttccatgccgggggtgtgcacgccggcgttggacagggcctctgcaagcacggtgcgccatgcatccgcctgaagctgcgtgcccacccactgcgcatctccggaaccgaatgcatgtctggtgatcgccgcatatgaatcccaggcataatggtcgtaccaagcgagtacgtgggtttccggagccggggagagcatctcgatgaagtcgtttgcagacgcgccggcgaggtcggccaaagtgtcggggcatttgagcgatacacccatcggacgagtgaactggttgtaggtcatgccaaatatgtcgacaagatgatgcggtgccttgtcgtgccacactttcacgttctcgtccgcaacgaatgaccgcatggtggcgagcagatgaccgccattcttaacataccgcgccaatcggtcgatggtctgctgatccgtggtatacaatgcgggtgcgatcaccagggagtaaccggcgagttggtctgcgctcgcatctgcgggcaggaaatcgacctccacattgagctcgaacaatgcatcgtatatggatcgcaacacgtcgttgtatgtgagcgtgccgcccatggggaatcccgtttcgatgtggaaccaggacagcgcggtgagcgactcgttgctggcgaggattgccaccgcattgcgttttgacagatgactgagcgtgtctccgatacgcgggtcgccgatctcgcgtccaaacctcccggcctcctcgtaggtgggattgctctcgaaatcgtgcgacagcagtccgcgccaatacgtttcgaacgaattgtgaattgaatgccaatgccagtacatgattccatccgcaccggatgcgagatgactgtaggcttgaaggcgcaattggcctgggtacggcagccaaccatgctgaccctgtgcctgcgtttcgagcaccaggtaattgccgccgcctgccgaacgtgccatgtcgccgccgaatgcgatctccttgccggtgagtgcatcctcgctcggatggtagatgtcgacgccgcagatgtcgagtgcgcgggcggcacggaaatggtcgaccgcaggctgtaacccataggaatgaccgcgccattcgtaatcgaaattatgagtgatgaactggtcgtcgcgcatatactcccgaataatgctcgcctgccatgcaagatactccgccacttgatcgcggcggaacctgtcgaatcgcgcgcgcaacgactcgttgatcgaaccggtgagatccgggaagtcctcccacgcattgatccgattcgaccagtaatccaagccgtacgcctcgttcaatgcctcgaggtcgttcttgaattcgtggcgtagttgtttgatgaacatcacctgcatgtcgtgggagacggaatcgtagtatttcgtctcattgtctacctgatagccgatgacgcaaggctgctgtgccacgtgggagatgagggatcggatcaccctctcgccgtaaaggcggtaggccgggttgacgatgttcatgatttgccgcgccccgtagtggggttccccggccggtgtggtggcaaggacgtccggatacatggcgacgagccatgtgggtaccgcataggtcggggttcccacaatcacgttgattccggcgttggtcgccgcgtcgagcgcgcggtcgatgtgcgtccagtcgaaatgcccgggctggggttcgcatgtggaccacgtggattcgccgatgcgaatgacgttgatgcccgctcgggtcatcatctccatgtcggtgtcaatgcgatccagatcgcgcgggatgtattcatcatagtatgctgcgccgaacagaatggggtcggtgtatgcgcgggccatgtgtctctccttggttccgctatgtgttgtgcaaggtgaacggtggggcggcattgcccctaccgcaagcgtcgtatatgtccagattatctactttatggtagatataagaagtatcgtaccgggtctcatcttcctccgcaaatgatgaatccatctgcgttgtatagacaacttaactgatttcgcagcttctttggctcggtgtatattgtgaaacacatttaactattaggtggtagttaaatgtgttttacgcaacccttccagttccagtttggttctactatcaaaggagatagagatgtcaactgtttcattggagcaaacgtcgtctgcgctcagtcggagcgatagaatacgtctgctcgcatcgttcctggtgtttcccctgttgtggtgctcgggcttgttcatggtcgcggccgtcctgttgcctcagcgcttgcgcgacgtgatgggagcggatgcggcgactgctgcattcggcgtcatcaatgcatgcacggcgttcatctcgctgctgtccaatctcgttgtgggcaatttgtcggaccacactcgctcgagattcggccggcgcaccccctgggtcatttctggcggcattgtcggcggcgtatcgcttgcactggtcggtttccttgacaatgtatggctgatcggcatcagctactgcgtatgcatgattggcctgaacatgatgatcgcgccggtcattgcgaccctgtccgaccgagtgccggccaatatgcgtggcacgatgtctgcgttccttgccggtggtaccgcggtgggcagcgctctcgggcagatgctggggtcgaggttcctctccaatcagatccccggattcctgctcagcggcactctgatggggctggcaggaatctgcacggtgctggtctggccaaaggagccgagttcgaagcatctggcaaagacgtccaacggtttcggggatatgctcaaatccttcatcccccccaccaaaggcgcccgtgatttctggctggcgttcgtggggcgttccctgttcatcttcgcgtactacatgatactcaattaccaactgtatgtgcttgaggattacgtcggacagtcagcgcagcaggcgggtaacacaatcgccgtgatgtcgatggtctcgatgattgtgggcctggtgtcctcgcttgccggtggccccatttccgacaggatcggcaaacgcaagatcatgatcgttcttgcgagtgtgctgatggcggttggttttgtgctgccttggattctgcacagcccgttgtccatgatcctgttcgcagggttctccggattcggttatggcctgtatggtgccgtcgaccaagctctgaacgtcgatgtgcttcccaacaaagaggaggcggggaaggatctgggcattctcaacatcgcaacgacgctggggcagatggtcgggccgatcgtcacttcggccgttgtggccgcgaccggcggttatacggtggtcttcccggtggccattggattcgccgcattcgcgtcactcttcatcatgctgatcaaaagcgtgcggtaggggtcgagccatgtggtgtgatgatacgcgtatgccgcatggcccgatcggtacttaccggtagttgtcccaaacgggcgaggggaacagtatgcgttcgaaggcgatccattcgtcgtacaggtcaatcgggtcggaacgcagccatcgcaattggatgccgtccattgcttcgagggccatgcggtgcagtggcttgaagttctcccaagtgccgatctgcggtggaagtttccattggtagttgctgagcgtctgccagatgattgcaggtctgtgctcgaaatagtcgtgggccgggtgatccgggtcaatggactcggcctgcagaatggcgaacatctgcaccagatcgcggcgcttggcgttctctctcaccacatagcgcaagtaggcggggaagtgcggcgcatcccggtcgctgcctggcagcccgctcgcaaggaagtcccctggcatgcttgtggggtcgtagaactccttcatcaccatcgcagccaatccggccttgttgcccacgtaatgcagtacgccctgctgggtcattcccacttcggatgcgacatctcgcagggagatgccgttgtagccccgttgggagatgagtttgacggtggcgcggagaatctcctcctcacgctgttgcggggatttgcgtgtgcgtgtgttcacggattcctccacggaaggctgcatggtttcctacgtgattataaggcagttcccctgtctatgccgaatgggtctgttcgccgtcgattttcgcgggatgaatatgccgcaatgaataatgaatgtggcctccactcacgaatgagtggaggccacattgcatggggacgaagcgctcagtcgatgaggaacgagcgcatgaaccactggaactgctcaagcttgagcacgtgatcctgcacgatgttcgagctgatcacatcgaggtcgtcgagctccttgatcgcggtgcggtcggccttgatgaacgaatcgtagtacttgtcgagcgcgcgcaggtagtcgagtgtgttctggcgcccctcaagctcgaacttgtcccacgtgcggtagcgcacgatgtcgtccggacggccgcttggcgagccgcccagtgcggcgatgcgctcagccgtctcgtcggccatcgcgagcacctcgtcgacctgcgggtcgagcatctcgtgcacggcgatgaagttggggccggccacattccaatgcgcatgcttgagcacaagcgctgcttcctgctcctggctcagacgctcctggagaatgccgatgatcttctccgaagccacctcgtcgaggcctggaataatgaatgacaatgccatatgcacgtcctttcacgaaatcgcctacgttctgcaggctcttattcgagcttacgtacgtgaacccggcaacacatgagcatgagctgatagcctaatgtgacctagctctcacgacggctgtctacttgtcggaatgctccgggtcgttggcctgctggtcgtctgagacctccgtgccgccgttcgccgtgcccttgcgcacctcgatcgtctcgatgcggcggccgtccaccttcgtgatcgtcatcgtatacgcgtcatccaccacgaggtggtcacccacctcgcccatcttgccggaatgcgcgaggaagtagccggcgaccgtctcatacgggccgtcctcgagttcgatgccggtgagatcggcgaaatcctcgatggtcatgccgccgtcgatggtggcgacgccgtccacgaacacgtcggtgggcagcttgtctttcggggtgtcctccggcaggtcatactcgtcgcgaatgtcgccgacgagctcctcggtcatgtcttcaagcgtgacaatgccgtcggtgccgccgtattcatcaatcaccacagccagatgaatgccgcgtttgcgcagcagcgacaagctcggtagcagtttcgacgtgcccggcagtgaaatgccctcgcgcgtgacatcggccaccgtcttcgcattcgggtcgcgaacgtcgagcaggtcgcgcacatgcacgaatccgagtacgtcgtcgaacgatttgccaatcaccgggtaacgcgagtacggcagctcgcgcacctgggccgcggcgtccgccagcggggtgtcgccgtcgaggaagaccacgtcggcacgcgggcgcatgacctcggcgacaatggtctccgaggcgtcgaacacgtcgtcgagaatcgtgcgttcgtctttggtaagattcgtgttcgagctcaccagcacgcgcagctcctcgtccgagacctcggactccgtctcgttcgggtcgaagccgagtagtcgcacaatgccattcgtgttcttgccaatgagccagatgatcggccggcacaccttcgcaaatgcgctgatcgccggcacgacggcgcgggcgatctgttcattgcgctgcatggcgatgcgcttcggcaccatctcggagatcacaatcgagcagtatgaaatgacgagcgtgagcacaatggttgtgagcggtgcggccacattgcttggcacgccccagccttccaccaccggtacgatgaacggcgagatcgacgattcgccgaaggaggcggagaggaagccggagagcgtgacgccgatctgcacggtggacaggaacgtgttcgggtcacgggcgatcttcgccacgcgcttgcctcgggcgtcctcctgttccatctggtcgatctgcgaaccgcgcagcgagacgagcgcgagctcggtgccggcgaacacggaaccaagcagcaggaagacgaaaatgagcagaatgttcaaaccaagtgacatagcctcaagcgtatgtcattggcacgccaatgtgttcgccaatgtgaagagattacgagcgaatgacgcattctggtacggcagccgctattttcgattgttaggtggggctctttagcgtatcgactgcaaaaagcctttttatcaaacaaatgctcgaatggttgtctaataaaaggggctgggttgcgtatgttgctctaggcgcccacctaacaatcgaagatacgtaggctggcgcggcaatggcaggcttccatcagcttattcccttttcagtgagtcagaagctcagcacctccaccaggcccgtgtcgagacggtagcgggctcccacaatcatgagccgttcgtgggcgagcgcgtcgcgaatcatctcggaactcgtgacgagttgctcgattgtgtgcgcaatgtgcacctgctcgtagtcgtcacgcgaatcaaggccggccatgcgggcctgccatacggagatgcctatgttcttcaggaattcgctcgacgatgatgcgatcacctcgtcgagatcctccatgatccgttccctctcctgcgcgtcggtgatttcgtgggtgaggtgctcggtgagtgcatcgagttccttctccgcctgcgcgactgcggcgcaatgctggtgagagagcacgacgagcagactcacgtgcagcgacgagaccgcatattcgagcgtctgcagcacggcctggtcgagcatctcgccggcggtgcgcaccgtgaacatgtcaccgagacccgcatcgaagatgatctcgggaggcacgcgcgaatccgagcagctcagcacggcggcatcggggttctgcgtgtcgatgagcgactcacgtgtctccttgtctcgccacgggtgctccgcgttgccttcggcgaagcgtcggttgccggcgagcatacggctccatgtgctgtttgcggtggtttcctgagtgctgtcggtcatgattccccttatcgcctcgatgtccgctgggttacggtacatcatagaatctcttgaatacagttggtgatgtgttcgcgagcggaggtggcgatggcggggcataggggagcgaagcggccctccattttcgaggtggcgaaactcgccggcgtgagccaccagaccgtgtcacgcgtgatcaaccattcccccaacgtggcggaggcgactcgcgcgaaggtggagcatgccattgccgaactcggctatcaccccagcaattccgcgcgctcactggcgtcgaaccgcacgcgcacggttggcatgatcgccggtggccagcgtttctacggcccggtgagcgcattggcgtccattgaggcgactgcccgcgctcatggtatgttcgtttcggtggccatggtgcatgaggccgagtgcacacagcaggaattcgacgatttgtgcggcatgttcatgcagcagggcgtcgacgcgttcatcttcctgacgcccaccgacgagatgttcaaggtggcctgcaagtcgcaagtgagccagccgtgcgtgatcatcacctcgtcgcacggcggtgtgagtgtgagcgagggcttgcacatgttcaacgcacgccagcgcaggcgtgtttcgttggtgggcatagaccagtgggccggcatggcgtcggtgatgcgactcatacgcaagcacgggcaccgcaacgtgctgttcttcgcggggccggggcagtggcgcgacgccagcacgcgcctgatggcatggaacaagctgtgtgcgcagaacaccgtgaattcggtgacggtgcagtgcggcgatgattgggaatccgccgacgcctaccggcgtatgaaccatattctcgacaacatcggttcgaacggcggccgcctgcccacttgcgcggtatgctcgaacgacgtcatggcgatcggtgtgatccgcgcattgctcgagcatggcgtgcgtgtgcccgacgatatgagcgtgaccggcttcgacgacatgcccggcatgagcaatctgtacccgccgctgaccacggtgaggcaggatttcgacgacctgggcacgatggccatgaaggaggcgctgttcctcatgggggaggaggccgagccgggttacccgaactcacagcatggcgtgggactggtgtcggcggacctgattgtgcggcagtccgtgcgtgcggcgccgcgcaggtgagagtggtgcgaatgcgtcgctcgccgtgccgctccgcgtgcgcgatgggggtctacttggaggggtcttcggtgtctgcggatttcgtgttccagccgagcaccgcattgactgcgcagtacccggtgacgatgatgaggcagatgctgaggatgatgttcgaccagctgaggagatctccactggcattggcctccacgcagttctggaagagccagatggcgcaggccacggcggtgagggcgtagaggcgggctcgtgcggtggaattgatgttcatgcgttcctccgagtgagattcgagtggggagcagatgtgttggcgaagagaggatggccgccggtgaatgggatcgccggcgacccattccgagaggggaagggaagtgtaggtggccggttggatggcatgctgccgtccaaccggcttgcaatcgctagctcttcttgcgcttggagaggatgtccaccgccacggcgcccaggagcacaagacccttgatcgtcttcaccactgcggtgtcgacgcccatgatcgacaggccctggttgatgacgcccatgaccagtgcgccgacaacggcgccggcaaatccacgctggtgcatgtgctggccggtctggagcagccggatgccggcagcatcgcggtgggcggggagacggtgcggctcgacggcgtggcgaaggccatcgacctgggcatagcgccggccttccagcaacctcagttctgcgagaatctggatgtatcggcgaacatcttcctcggcagggagatgcggcagggatttgccagccgcgacgatgagggcatgtacaacaaggcgcgcgaggtgcttaacacgctgtcgacgtccgtgcgcgccggccagagcatcgcgtcgctttcgggaggacagcgccagaccatcgccatcgcgcgcacgctgctcaacgatccgagcctcatcgtgcttgacgagcccacggcgtcgctgtcggtgacgcagacggccgaggtgcttgactacatcgtgcggttgagatcggacgaccgcagcgtcatcatggtctgccatgatctgccgaatgtgttcgcggtcgccgatcgcatcgtcgtgatgcggctgggtgagattcgcgccgtgcacaacacgtcggagacctcctacgaagaggacatcgcggagatcgccggcgtgggcggatccggtacgacgccgtctcggccgtgcgaacgggcgtcgcgtgcgcgcatgccgattgcccgcgagtcgcatccgcgcccgtctcgcggtggggatcgcgatggaaccatggcatgaacgagctgtcatgtggttcccatctgcgctgcctaagttgcagcgtgtgtcgggctgcgtccaatttgcgtaatttgggacgggttctgatgggtttttgtcccgttttacgcaggtggaaggttttgtcaccttttgcgcagggtgagaagaaatgtaagaaacgacagaagtaagacaaaggtaaggaagggaatggcatgggtgcagcggaaatcgtagtcaccgtggtgacggcggtcgcatgtctgggcatgggcgtgtttctggggtcattgccgttcaaacgggacgagttgacggaatggcatatgaaataccagcagctcggcggtgtgctcgcctgcggcattgtgatcgtgctgatgctgctcggctatgatctggcatcgtggctcgcaatcgcggctctcgcagtgggtgtggcggtgagtcgcattccggtggttcggcgaggcttgctggcgcgtttccccgagctgcatccggccgaacggcagtcgccgttgcgcaagggcacgtcaaagaagcgccggtcatagactggttgacgagcgctccaccaaggtgaaatcggatgtgtatacgcgtttcgcgccatcgtacccttgaatgcgttcgatgagcatgtccaccgcgtgccgcgcatagctgtcgatatgcgggtcgattgtcgtcagggaagggttcgcatacgtcgcctccggtacattgtcgaaacccaccacctgcacatcgtcgggcacccggattccccgtacctgcaattgatgcaacgctcccagcgccatcgcgtcattgagacagatgatggcgtccggtcgcacgccttggtccatcatcagattcgttgcgcgaacgccgctgtcgctcgtcaataagccacctgagaacagcatgtccatgcgggcctcgatgccatgctcctcgtatgcctgcatatacccttgcacgcggagttcctgcgtaccctcggtggcttgtcggtaatgtcttgcgccgagcgagccgtctgcgccgaacagcgcgatggaacggtacccggaatcaagcaggcgattggtggtgtatcgcatcgcctccacgttcggcatggtgacctgatccaccttgccataggcgtcccagtcgccggtgagcaccagaggatagctttggtcgagcatcttgctgtgttgtcccattgcatgatcggcgaagacgatccacccgtctgcggccagattgttcgcctgccgcatcgcccgtgccaggccgtgctcattctggccgtaggtgtttatgatgaccccgtaatgatgctcccgcgcgcagacgatgatctgatcggccagatacgaggcgaatggctgggagaaatcgaagatggccaatccgagcaacccggttgtgccggttttcagtgaacgtgccgacaggttgatcgtgtagttcagcttgtccattgcctcaagcacgcgtccacgtgtcgattcacgcatgctgccggtgccgttgatcacgttcgagactgttttgaacgatacgccggcctcggccgcgacatccttgatggtcacgccttttgccatggtcggtctccgatgcgccttgctgtttacctatgcattgcctatcgccttgaatcgcatcactatgcacgttgccggggatgccggtggcccagaccgacggtccgggccgttgtgtcagcgcagatggattgcggtccaactcaccggcggaagggtcacggtgaccatgccatcctggatggaggcggtgtcgttggggtggggcaccacgcgatcctgatggttcacggtgtttgtggccagcatgtcgtcatcgtgcaacgttctcacatcaagctcggtaggtgtgaaaccttccggcaacttgatctcgaagtcgcatccatcgtccagcgaacggttggtgacaaacacggagaccgagccgtctttgcctcgcacggccacggcattcgtggagttcacgttgccatagcggttggtgtggtactgggtggactcgatcttgggctccagcacatcgccgcccttggcccaggctgcggtgagggagaacgggtagaaggtggtttggcgccaagcgggcccattcggctcggtcatgatgggggcgatgacgttgacgagctgagcgagtgatgccgcatgcacacgatctgcgttttgcagcaatgtgatgaggaggtcacccaccaccacggcatcggccacggtgtagacgtcctcgagcagccgaggggccacgggccagttgcctatgccttccgggttcttgctgggttcctcctcgtagtaccacacattccactcatcgaaggaaatgtacacgttgtggtcgctcttgagtcgcgccttcgtggcgtcgatggcggcgcccacatctttgatgaatccatccatatccacgccggaggcgaggaacgacgccatgtcgcgcgagccgttctccatcagctgcgggaaatagtaggcatgtgctgaaacgaaatccaccttgtcgaaggtgtgctcgagcacggtctcctcccatttgccgaaagagtccatcgtatggttcgatgaaccacagacgaccagctcaagatcggggtctaacatgcgcatgcctgccgccaccgaggccgcgagcttgccgtaggcctcggcgtccttgtgcccgagctgccaagggccgtccatttcattgcccaagcaccacatgcggatgtcgaacgggttatcggcgccgttgcgaatacgttcctccgagcgggcagtgccttccggaacgttcgcatattcaagcagatccagtgcttctggcaatccgcgggtgccgagattgacggcttccatcaactcgttgccgccggccttattcagccatgagaccatttcgtgcagcccgaactgattcgtttcggtggaatgccaagccagatcaaggcgacgaggtcggttctcctttgggccaatgccatcctcccattgatagcctgacacaaagttgccgccgggatagcggatggtggtggcaccgagttccttgaccagatcgatgacgtcttggcggaacccctcggcatcggcagtgggatgccccggttcatagatgccggtgtacacgcaacgccccagatgttcgacgaacgaaccgaatacacggtcgtgtaccgggccgaccctgaattcgtcatccaccaccagtctggcttgtgcttcgctatgctgcggcatggtatgttttcctctctgctgcactgaatgcaacgttgttcttctctgcgacgtctcttcgtcgtcgaagagatgggattgagtgtggttgagctagtacaaccttgtacttcatgttaccgctcacaagatgcttgcgcggcgggaaatgctcaaaggttagataacacttgatattcagccatttgctcggcgtgtcgggttggtggacgtgatctatgcccaggggtatgcccctgttcggcgtgttctgtttgtgtgagcgctaacatatacatgacgcatgagttcattgcggaactgaatcccgaagcaggaggaaccatggcagattcgaaggcgattgcacaggccattcgtgacgggcgcacgtcgttggggattgaattcggttccacgcgcatcaaggcggtgctcatcgacgatgagcgcaatacgatcaccaccggtgattatggttggcagtcacatcttgtggacggcctgtggtcgtatgacgtggacaagatctggcgcggactgcagagtgtctatgccgatgtggccgaccgcgtggaggccgattacggcctcaagctcacgcgcatcggccagattggcttctccgcgatgatgcatgggtatctcgctttcgatgcggatggtgaactgctcgtgccgttccggacctggcagaacaccaacacgagcgaggctcatgagaaactctccgagcttttccaatacaacattccggaacgttggtcaatcgcgcacctgtatcaggcggtgctcgacaatgagccgcatatcggttccgtgcgctatttcaccacgctttccggctatgtacactggaagctcaccggtcgcaaggtgctgggcatcggtgatgcgtccggaatgttcccgattgatccgaacaccaagacctatgagcagggattcattgaacagttcgatgcgctgcctgaagtcgccgcacaaccgtggaagctcaacgatttgcttcccgaaccgcttgttgcgggcaccccggccggcgaactcacgccggaaggcgcggcgctgctcgacccgtctggcgtacttcagccgggaacgatgctcgctcctccggaaggtgatgccggaaccggcatggtggccacgaactcggtacgccgtcgtaccggcaacgtgtctgcgggaacctcgatcttcgccaccgttgtgcttgagcacaaactctccaagttgcgccccgaagtggacttggtgaccacccccgcgggcgatctggccggtatgagccatgcgaacaacttcaccgccgatctcaatggatgggtggacctgttccgccagttctcacagctcaacggacgaaacgtcgatgacggcaccctgtacggcgagctgttccgcgcggccataggcgaggatgcggatccagatgccggtggtctgctcgcctacccattccgtaccggcgaatttctcgccgggctcgccgaggggcgtccgctgttcgtgcgcgggcccgaggcgcgattctcgctcgccaacttcatgcgggcacagctgtttggcgcattctcgccggtgaccattggtatgaacgtgatgaccgaggacgagggcgtcgagattgactcgctggtgggccatggtggcatcttcgccacgcctgtggtggcgcaacgcattctcgcggcggcgttcaatacgccgatccgtgtgatgaccaccgcgtccgaagggggagcgtggggcatggccgtgcttgcggactatttgcgtcacgccgatctcacgcttgcagattatttggacgatgtcgtgttcgccggggcggaatcggtgaccgaagctccccggccggacgatgtggatggattccagcgattcttcgccagattcgtcaaggcgttgccggtggagcgcagtgccgttgagcacgtcgaaatcggtgggtgaatctgcagcgtacggatctgcgcaagtatctgaaactgtacagaaaggaacaacaatggcaacactggcggattatggaccggaagtccgtgcggaggtcaagcaggtgcgggaggtggtcgccgcactgcacgaacagctcatcaagtggaatctggtggtctggacggcagggaacgtttcgcagcgtctgcgcacagctgacctcatggtaatcaaaccatcagggctgcgttacgaatatctgacaccgagctcgatggtcgtgtgcgacctcgacggcaacgtcgtcgacggtgcggaatcaccatcgtcggacactgcttcacatgcatacatctaccgccacatgccggaggtgtatggcgtggtgcatacccattccacctatgcgaccgcatgggccgccaccgggcagaatattccatgcggattgacgatgatgggcgacgagttcggtggtccggtgccggtggggccgttccgtctgatcggttcggaggccattggcgaaggtgtggtcgagaccctcaaggcgtacccgaaatcaccggccgtgctcatgcagaatcacggcccattcaccatcggcaaagatgcagaggccgcggtcaaggccgccgcgatgaccgaggaggtggcgcatacgatgtgggcggccaagcagctcggcgacatcattccgattcctcaggaagacatcgataaactcaatgaccgctaccagaatgtgtatggccagcactgacttgcaccatcacaatacaactgcatacacaaattcaactgcgtaagaagagacagattcgcatggtttttgtctcgaattacgcaaggtagcaaggcggcaaggcggcaaggtagcaagtcggtttgcgtagaaagggacagaaactgcggttattcgtcccggattacgcaagggcgggcaaatggctgagtcatccatacatcaatccacatcggttcataatcaattccaacaatccacaatgaagtgaggaaaacaacatggcaatggaaaatccgttcgaaggcaaggagatctggttcggcgtgggctcgcaggacctgtacggcgaggaggcactgcgacaggtggcgcaacagtccgccgagattgtcgactcgctcaacgcgagtggccgcatccccgtcaagctcgtgctcaagcccacgctgaagtcgtctgacggcgtgcgtcgcttcatggtggacgcctcggccgatgattcatgcatcggcgtgatcacgtggatgcacaccttctcgccggcgaagatgtggatccgtgggctcgaggcgctgcgcaagccattgctgcagcttaacacccaacaccatttcgagattccatgggagaccattgacatggatttcatgaatctcaaccaggccgcgcacggcgatcgtgaatacggctacattgtcactcgtctcggcatcccgcgcaagatcgtcgtggggcattacaccgatcccgcggtggccgacaagatcggcgtgtgggcgcgcgcctgcgccggttggcaggcctcgaacacgatgaacgtgatgcgctggggcgacaatatgcgcaacgttgccgtcaccgaaggcgacaagaccgaggcggagcgtgtattcggcgcctcgatcaacacctgggccgtcaacgagctcgtcgccgcgtacgatgcggtcaaggagaaccagatcaaggacctcatcgaggactacaaggcgaagtacgagatcgcgcccgagctgctggacaaggactatgattcgctgttcatcgccgctcgtgaggaatgcgcaatggtgaacatgatgcgcgccaatggctgcacggctggcgtcgacaacttcgaggacctcggcgccctgccgcagctgccgggcgtgggtccgcagcgcttcccgtccgaatacggctggggattctcggccgagggcgactggaagacggcagtgctcgtgcgtatcggggccgtgatgggctatggtctcgagggtggtgcgtcgctcatggaggactactcctataacttcaccccgggcaacgagatgatcatggggtcgcacatgcttgaggtctcgccgtcggtgggcacaatcgccaagccgcgtctcgagatccatccgctcggcatcggcggcaaggccgatccggttcgcctggtgttcactgtggctccgaagaaggatgcggttgtggtctcgctcgccgacgtccgtactcggttccgtatgctcatgaatgtggtcgatgtggtcgaaccgctcggctcgctcgacaagctgccatgcgcccgtgcgctgtggaagccggagccgaatctggagatttccgccgaatgctggctgcgtgcaggcggctcccaccatacgtgcatgaccacctcggtcggtcgtgaggcatgggaggacttcgcgcgcatcgccggcgtcgaactcgcggcgatcgacgccgagaccacaccgcgcgaattcgaacgcgaactcgagattgaggacgtgttccacgagcttgccaatcgccactgattgcccgattcccacgttccttccctgccgtgcgccggtacctgttgcgttccggcgcacggcatttccgcgccccgcatgctgatgcggggcctcagtgctaacatcggccgtagaaccacagaaaggcgcatatgagcacgctcgctgaccagactccagatatccccctcatcactctgcacgacggcagcaggattccgcagataggcctcggcgtgctgcgcatcgacgatgagggcgtcgtgccggtcgttgaatcggcgctcgcaatcggctatcggcatatcgacggcgctgccggctacaacaacgaggagggcgtgggacgtgcgctcgccgcgaccggttacaacaccggcgaacagcgcgagagtctgtggatgacgacgaaactgcgtgattccgagcagggctacgattccgcgatgcacgcgttcgaccgctcgctcgaattgctgcagttggactatgtggacatgtacatgatccactggcccacgccgttcgattggcgcagcggcgagacatggaaagcgttcgcgaaactacgtgaagacggccgtgtacgtacgctcggcgtctgcaatttcatgcccgagcacctcgacaggttgtatgaggagacgggtgaatacccgacggtcaatcagattgaactgcatcccacgtggcagcagcgcgatgtggtggaatactgccatgcgcacgatatcgcggtggaggcgtattcgccgatggcacgcggcgccgacctggcgaacggggtgatcgagcggatcgcggaggcgcatggtgtgacccctgcgcaggtgattttgcgttggcatatcgagaacggcacgatcatcatccccaagtccgtgcataccgagcgccagcgtgagaatctcgatctgttcggcttctcgttgactccgcaggagcatgccgagatcgacgctctcgacggccccacgcgcgccgggcacgacccgatgacgttcacgtacgcctgatatctgcgtaaaaagagacagatttcgctatcgaactgtctctttttacgtaatcatctgattcctacgtaaaatggggcataatcgacggcgatttgtcctgaattacgtacaaagcgcgaggcgcgaggcacaaggcgtgaggattgtggggcggtggtcgaggcgcttgtgcggaacaggagagccccgcaatcctgtgggaatacggggctctgccatgcttgtcgatcggtggaatcagccggtgttctgcaggccggcggcgacacccgaaacggtgcagaggatcaggtagatgaatcctgcctgctggctttcggagagctcctccttgtcgaccttcttacgcagcgaacgcaatgcgagcacctgcgtgacggacagtgcgtcgacgtacggggagcggatgcgaatcgcctggccaagcacatgacggtgctgcagcggccattcgtcgccgacgatcttgagcacccacttgcgtgtgagttccatctcgtcgagcaccttcttcgagaggtccgggcggtcgccgagtgcaaggtacatcttcgcgatgcgttcgtcggtcttcgccagcgacatctcgatgttgtcgatgaacgtggagaacagcggccattcctcgtatgccttgcgcagcgtggcgaggtcgccgaacgactcgcatgcggagccgaggccataccaggcggcgaggttgatgcgggcctgggcccacgagaagatccacgggatcgtacgcagatcgtcgagcgacttggctcccaagccgcgcttcgcagggcgggaaccgatcggcagcaagccgatctcggtcaacggcgtgacgatcgagaaccatggcgcgaagtcctcgctgttgagcagatcaaggaacgtttcatgtgaaacttcgctgagctgattcgccattggcttgtacttctcggtcatctcggtgttcgtcttctccacgctcggagccgactgcaacagcgtcgcggcggccacggactcgacgtgtcggatggcgagtaccggattgccgtagcgggcgaagatgacctcgccctgctcggtgagcttgaagcggcacttgaccgaacccttcggctgtgcgagcaccgcgcggttggccgggccaccgccacgaccgacggcgccgccgcggccgtggaacagcgtcagatcgatgtcgttctcgtccgcccacttcgcaatgcgctcctgcgcggagtgcagcgcgagcgtggcggtggtggggccggcatccttcgacgaatccgagtagccgagcatgacctccatcttgcggccggtctgcttgagtcgggcctgcacctcgggaatcttcagcatctcgtcgagcaccgagaccgaatgctcgagatcctcgagctgttcgaacagcgggatcacgtcgatcaccggggcgtcgtccggattcgagaacgccagacggttgagctcgtacacgtcgcgcacgttcttcgcgctcttcgtgaacgagatgatgtagcggcgcgcggccttgacgccattgcgcttctggatcgcgccgagggcacggaaggtgtcgagcacctcatgcgtcatcggctgcaacggtccgcgttcgccatgcaggccgtgctcgcgaatgtcgtcgagggcgcgcgcatgcaccaccgaatgctggcggaactccatttcgaccatgtggaagccgaaggtctcggtctgccagatgaggtcctgcagcgggccataggcggcgcgtttgtcgccggcctcggcgagcgaacgctgcaccacgcgaagatccgcgaggaagtcgtcgcagttgtggtacatgagatcggtgtcgcgcttgatcgtgtaatgcaggcggtcggccatgacgagcagcaccgcgcgatgcagctccttcgtggagatgagcgatgccttgccggtgagtcgctcgctgatctccttctgctggttccacagcgcgcgcagttcgtcgctcggtggcgtggtctcggattcgacggtcatgttgcggccgacggtgcgcgtggcctcctcgagcgcggcgagcacatggtcgctgaacttgcgggccacctgacggctcaccttggcggtgacgttcgggttgccgtcgcggtcggaaccgatccagctgcccgggtggaagaacgcggggcatgccggcggctcgatgcctgccttgtcgccgagcatccagtcgtcgaaacgacggtagaccatcggaatcgtgtggaacagcgtgttgtcgaagatgtcgagaatcgtgtcggcctcttcgacaggcgtcggcttcttcagcgcaatcggcgacgtgcggaacagtgcgtcgatctcgctgtacaggcgacggctgtcctccttcttgtcggagccgccgagcagacggtgcgcttcgagcagctgtgcgatgcggcggatcttgccttccacggccttgcggcgcgcctcggtggggtgtgcagtgaacaccgggtggaattcgaggcgttcgagcagctccttggccttggccggacccatttcggagatgagctggtggtaggccttcgtcatctcgttcaccggatcgatggcctgggtgtcgtcgaccttggcctcgcgctcatggagcacggccacacggtagttctcctcgcacagattcgccaggtggaagtacgtggcgaacgcgcgggcgagcagctgagcatcgtgcagattcatcgcatcgatcgtcttgacggccatctctaggtcgtctcgttcgggatgcgtgtcggtgagcacgccggagaaccgctcggcactggcatcgacggcatactgacgcacggtgtcaaacgttttgagaagattctcgtcgtattcggaaagcacctggcgcagaatgttcagacacaagtccatgtcttcctgcaatgtcgcgggaagcgtgcgctcttcgggacctttggtgccgagcccggacgacacgatcgtggcgtcggccggcgtgatcgtttgctcttgatcagtcattcgacctctttctccaaacattgggttgctcggtctatcggtcttctgcggctcctccgcagttcttggcgccgatcgttgcgagcccacagcccgtgttcagtaaagttgcgtttgtattgtaagtacgagcatgagacacgtttgttacgtttgggcaggggcggtcggagtgtgagattgcgtctttggcggcggccatcgcgaatgttcgcgcgggggtagtagaagtagagatgtgagcaagagcgaagaagaatctgcaaccaccaccgacgacatgcatggtcatgaccggcacagcgcacgcgtgcactggcgttcccggcccgtgaagtcggcggccggggcggtgcgcagattccattcgcacgcgatcccgctcgacatggaagacatcgagcgcgactgggacaagccgatcaccgacgcgggcatcgccgccaaggccagtgtgatcgtacgcgtgggcatgctcgacctcggcgcgggcaccggaagcttccgtgtgcgcgagatgatgcaccgcatcgcctacccgctcggcgtgcatgtgcgcgcggacgtcaatctgaccgacgtccaggcctcctgcaccgacggcaaggaacgcatcaccgaagtcgtgaatctgccgacgaccggcgtgaacaccgagcggatctggctgctcgagcattttgcggactggttcagcgtcaatctcggcgcgggcaccatgtaccaccgtcgcaccgaggtctcacgccagctcatgcagccgaacacgctgggcacgcgcgacgcctcgcagatctccgcggagacggcgaaacagctgcgagaacggctcaggcaggaggcacgcgcgcaaaaactcgcggcgaaacgggcgagcctgcgctcacgggtcgccgagcgggttgccgaacgcgcgaagaagaagttgcccgaagacgaatacgccgagcatttcgaccatctcgaagaacatgccgagaagcgcgtgcgcgaatccgggccgatcacggtgggccaggtgcacaagcgcctcgacttgatcgaacgccgcaagccgctctattcgtcggccttctccggattcgccgccgcctgcgcctgcgcggccttcgtgttcctgctcggcggtgcgccctacgacatgatcggcgcgttcatcggtgccggactcggccaatgggcgcgacgcagactgttcgcgcaccacctgaaccagttcttcgtcaccttcgtggcggtggcggtggcggcgctcgcctgcgtgggcacgctgcggctcatcggcatattcgacccggtcgcgctccaccacgacaccgcctacatcggcgccatgctgttcgtgatccccggcttcccactcatcaccggcggccttgacatggcgaagatagacttcccctccggggtgcaacgcatcgcctacgtgtgctgcatcatattgatggccacgctcgcgggctggatggtcgccgtgctcgtgcacctgaacccgcaaggcttcgacacgccgccgttgaatccgtgggccactggtgccctgcgcgcactgttcgcgttcgttggcgtgtggggcttctctgtgctgttcaattcaccgcagcgcatgtgcctggtggccgccacgatcggcatgatcaccgacaccctgcgcttggagatcgtggattggggtgttcccgccgaagccggtgccttcattggcgccctgcttgccggtctcatcgcctccgcttggcgttccgcagtgcggcacggtctgctcgcaccgcatctgggttacccgcgcatctgcctgacggtgccgtcgattgtgatcatggtgcccggcctgtatatgtaccgcgcgatgttctatctcggccagttcaacacactgctcgctctggactgggcgttccgtgcgttcatggtgatcatctgcctgcctatcggtcttgcgatggcgcgcgtgatcaccgacaaatcctggcgctacgacgtgtgattctcgtctgccctccgtatggcgggtgtgggagggccgggaaagacctcgtcactggatcgcaagcgccctttacgggctcttctcaggttagtgtgtaaggatgtctttgagttggctgctgtggatgaggcatcgttggatgtagctggtggtgttggcgaagcccatggcgttgccgcgcagggtctcgagcctgccgttgatggcttcggtgggtccgttgcttgagcgggggtggcggaagagggcgaggatgtcgcgcatgcgtcttttgagcacgcggccgagggaggcgagttcccggcagcctttgtagcgccccggtccggtcaggtcgtcgatcagctcgcgcatcatgcgttcgccgcgtcgcctgtcgtcgcaccggtaggcgtgtatgaccctttggtaggcgtcgtgggcgagcatgaggtcgcggttggcctggatggcgaacagggccatgagtctggcacggccgcgtgcgccgaggtattcgtcgctggtcagcagggcgcgcctgcagtcgtagagcctgtcgcccttgacaccgcgcctgccggtggcgtcgcgttgcaggcggcagcgcaccttggtgacgcgggcggcggccagttgcacgacgtggaacgggtcgatgacctcgaccgcgtggggcacgacggattcgacggcctgcttccagccggcgaacgcgtccatggcgaccaccccgacgcgtcttgtgaactcgccgccgcgcgcctgcatccattcgcgaagcacctgggcggaacggcccggcaccatgtccagcagtcttgccggcctgccgtcgcaacgcggggtcaggtcgacgatcacggtcacgtaccggtcgccgaacgcgccgtggcgccacacgtgctcgtccacgccgatcgcgcgcaccgaggagaaccggtcggcctgctcgagcaacagcatgccccgctcgcgcaccgcccggtcgaccaccgcccatgccacatgaagcagcctggcgcacgccgagaccgtcatcgagtccaggcacacgcgccgcagcgcccacatcaccgccggcacgctcaacacgcccctgccggcgcccaccgcctcaggatcatcgctccacgagcgtgagcacggcacgcactcgtagcggcgcacgcgcaccagcagatgcaccgcgtcgtcgccgtagggcacatgcgccagcgtgcgcagccacgacgaacgcaccctggcatacgcgccgcacgaggggcaccagcgcgcgtcgtgcgagtccggctcgcacctgatctgccttaaccccgggccgtccggcctgccaagacgccgccacgagagcacacgaagacccatctcatccaaaccaaggaaacgttgggggtcgaacacgctaaactcgggttcaggccgtgtttcctcattcaatttctctatcacacaagcaatgatgaagcacggcccttacacactaacttgagaagagcccctttacgttcctcgatctttcccgggccctcccacacccgcaggtcgtttccggcaatctgcaatgaggtcttacctcggcatggcgttgggctcagcggtcgtagcgcatgcccatggcctcgcgcacctcgtcgagcgtctggttcgcaatcgcgttcgcgcgggcgttgccgtcatgcagaatgtcgcgcacggaatccatgtccttggcgagctcggcacgacgctcacggtgcggtgcgaggaattcgttcaccgagtcgatcacatacttcttgagcgcgccggcaccggcattgccgatctcggcggcgatctcactcgggtcgcggccggtgaccagacccgcggtggtgagcagcgcggagacctgcgggcgattgaccgggtcgaacgtgatggtgcgctcggaatcggtggggctcttcttgatcagcttggcggtctcctcggcggtcgcgcccagcatgatcgaattgccgtacgatttgctcatcttgcggccgtcgagtccggggatctccggcgcctccgacagaatcgcggccggctcggggaacaccgggttcttcttcgcatagcgttcgttgaagcggcgcgcgatcgtgcgcgtgatttcgacgtgcggcagattatccttgccgatcggcaccacgttcgccttgcagaacaggatgtcgcacgcctggtgaaccgggtaggtgagcagcagtccggtgagcgcatggccggaggattccatctcagatttcaccgtcgggttgcggtgcagctcggcttcggtgaccagcgagaggaatggcagcatgagctgattctcggcgggcactgcggaatgcgtgaagatcatcgtcttctcggggtcgatgccggcggccatgtagtccagcacgagattgagcacgttgtcgtcgatgtgctcggtggtatcgcggtcggtgatcacctggtagtcggcgatgatgatattcgtgttcacgccgagattctgcatggcgacacgctcgcggatggagccgaagaagtggccgagatgcagacggccggtggggcggtctccggtgagcatggtgaatttgcccgggttcgccttgagcttggcgagcgtttcgtcggaacgcttcttcgccgcgaggaagctcgcgctcatttcattgcccgccgcggtgagttgcgcgttcatgtcgtcggtcatgccggtagcctcttctcgtctgtatgcgtgcgtctgcatgcgctgtatggcctatgtaataaagaatcatcgtagaaattcgagaagacaacacaatgtgtctgaagtggtggtactctcatatgtgatgaatcgaaacaaataagtatcagggggtcgcatgggccgcggacgtcagaaagccaaacagcagaagatcgccaggaagctcaagtatatgaccactgacacggattacgacgagcttgccaaggaattgggcgcgcacgagccggggaccggctcattcgatccatttgccgatgtcgagaacgacgaattcgaggcacaggacgtcgacgagacggtggatgacctcgacgaatacgcgaagtgggccgccgaagcagcggcgaaggccacgaccggagagatgccggagactcacgcgcaacccaaaccaaagccgcacaagccgattccgatgccagtgccggaaaccttcaaacacacagaccagcaggagtagatccgccggttcggtgacatatgaattcgtgaggggcgtcgcgatgagcggcgcccctcacggcgttcgggtgcggatgtgtgtagatgtgagtatagggctcggcatgtgcgcgtccgcattgatccgcattgagatggtaggcgtcctatgcaaacgattgcaaaaagagatgccgtgacgctcatccgtacggcgtcagccgagcggcagcagcggcgacagatcgtcgcgctcgccgaccgcgctgatgcgcccggccttctgctcctcgtgccatgtggtgatgccgctggcgacgcgcagccaaacctgcggatcgagctcgatcacgtcgggaggtgtgagattatgcggatccgaggcggggccttccaggatcttgaccaccgcgtacggcgcgacgcgcacctccacgcccgggccgggtgccttgatttccagctggtgaagtgagtagcgcacggccatggccatggtggcgcggtcgagccggggtgcgatgtcgagggccggcgtggtctcggctgctgcgcgcgccgccgtgcaccaatcgtcgtatgcctgcatgccgcgcatcatatcttgcttacgaattgctgccatactgtgattctgcatcgaacgctcgataacaatgggctgtttacccatggggcattaatccttgtgaagacgctatggtgattgcgaaaaactcgttttctccgcgtaaaaagagacgcctggcggctgtattcgtctctttttacgtcacggtgaaagtcataggggaggagaaggggaaaaggggagagagaagaagtgtggaggtctgttgttctgcgtaaaaagtgacatttggtagtcgtatttgtctctttttacgccaagggaggcgtcaaagagggatgcgtcaaagggtgttttgcgtcaggggctgttacaccaaaaggaggggaggggtaagccatgagatgcaagggtggtcgcggtaacgagagaagagtagtgtgcggtatatggataccaacgtttgcaatggtcgccgcagtaaacagtgcgcgaaacgaatgcggaaaacagagcgtttttcgtgaaaggagcaagcggtggtatattttatgagaacgtatgcaaaaacggatgcagcaatgcccgccgacgcgcacgttcgatgaggaacatataaagggagtcacgtatgaccgaactaacggcacctaagtccccgctgaccgccaacgaattcgctgacgaaattcgacaggcgctcaagtacacacagggggtcaccccggaacaggccaagacggccgatgtctatgttgccactgcaaccgtggtccgccgtcatctcatggattcctggatgaagacccagcaggacatgatcaacggcgacacgaaggctgtgggctacctgtccgcggaattcctgatgggcaagcagctgcgcaacgcattgctcaacgcgggcctcaccccgcagttcgaagaggccgtgcgcggcctcggcttcgacccgcaggcagtggtcgacgcggaatacgaaccgggcctgggcaacggcggtctcggccgtctcgcagcctgcttcatcgattcgctcgcctcgctcggcgttcccgccttcggctacggcatccagtacaagtacggcatcttccgccaggaattcgatgacgagggtcgccagatcgagcgtccggactactggctgtccaatgaggacccgtgggggcacatcgactacgagcgcgatcagcgcgtcaacttcggcggcaaggtcgtcgaggagaacggcaagcgtgtgtggaagccgagctgggccgtgcgcgcgatcccggtggactacatggtgcccggctacgcctcgggtcgcgtgaacacgctgcgtctgtggcaggcccgctcctacgacgagttcgacctgctcacgttcaacaagtccgagtacctcgacgcggtgaagccgcaggtcaaggccgaggatatctccaaggtgctctacccggaggactccaccgaggtgggcaaggaactgcgtctcgaacagcagtacttcttcgccagcgcctccattcacgatgcgattcgcgtgttctacccggacaccgacaagccggatctgaccaccttcgccgacaagatcacgttccagctcaacgacacccacccggtgatcggcattccggagctcatgcgcatcatgatcgacgaatacggctacgactgggacaccgcctgggaagtcacccacaagaccttcaactatacctgccacacgctgcttccggaagcactggaagtgtggccggcatcgctcattggcaagctgctgccgcgccacctcgagatcatcgagcgcatcaacaagcagttcgtctccgagctcgaggccaagggtgccagcgaagaccagatcaagcgcatgctgatcctcaccgacgacgagcacccggtggtgcgcatggcctacctcgccacctacgccggctccaacgtgaacggcgtcgccgagctgcactcccagctgctcaaggatgtcacgctgcgtgacttctccgacgtctacccggcgaagttcaagaacgtgaccaacggcgtgaccccacgccgcttcatcaagctggccaatccgcgcctctccgagctcatcaccgagggtctcggcaccgacaagtggcttgaggacctcgatctgctcgaaggcctcgcgccgctcgcccaggacgacgagttcgtgaagaagttcgccgccgtgaagcacgagaacaaggtcgcattcgccgacttctccaagcagcgctacggcgccgaactcgatgccaacacgatgttcgacacgatgatcaagcgtctgcacgaatacaagcgccaggcactgaagatcctcgagatcatcgccacgtactccgacatcaagagcggcaaggtcaacgtccaggacatcacgccgcgcacctacatcttcggtgcgaaggccgccccgggctactacctcgccaagatgacgatccagctcatcaacaacgtggccaaggtgatcgacaacgatccggatgtcaacggcaagatcaagatcttcttcccgtggaactacaacatcgaggtcgcgcagatgctcatcccggccaccgagctcgacgagcagatctcgcaggccggcaaggaggcctcgggcacctcgaacatgaagttcgccctcaacggcgcgctcaccgtgggcacgctcgacggcgcgaacgtggagattcgcgagcgcgtgggcgccgacaacttcttcctcttcggcatgaccgtcgacgaggtggagaagatgtacgagcagggctacgacccgagcaagtactatgaggccgacccgcgtctgaaggccgcgatcgacatggttgccgacggcacgttctcgaacggcgacaggaacacctacgccccgctggtctccgactggctgacgaaggactggttcatgacgctggccgacttctccgcctaccatgacattcaggccgatatcgacgcactgtatgccgaccagctcgaatggaaccgtaaggcgattctcaacgtcgccaactccggttacttcagctccgaccgttcgatcaaggactacctcgaccgcatctggcacacccgttcgctcgataagtgatgaacggtaatctgttcgcagattcctgatgggacgctttcggcctccgctcgcatatgcaggcggaggccgaaagcatattgcgcgagcgtatctatctgttgtgcatttgcgtaaatagagacgcatagcgctcgcgggtgtccgaaattacgcaagatggacggggcggtctgcggatatgcaaaggcgccgggtactcgaacacggtacccggcgccctgccgtacatgtgtgaactcaggcggcgtcctttgcggcgtccgcagccggctggtcaagatcgtcctcggtcttgtcctgtgccagggtcaggtcgaccggcgacgagctgttctcccacggctcctcccacggatcgtaatccgggttctgctgcttgtagatgtacagaccaaccacagccgcaagcagaccaccgaacagcagtgcaaagaacttccaaccgtttgaagacttcttctccatgacggctcctttcagtattctggtcgtccggttcggcccggtcgactctgccttccatcataagccccacatcgcaagatgacgcatattgtgctcatggcaagcggatgacgcgtgatgtcttaagtccccaatgatactccagttccatggcgattcggtagtcggtgccacggagtgtgcctggctgtgcgaattcggcaggagaataagcgggcgtcgcggccgagtacagtgggagccatgcctcgtcgtggatttagtttgttccctgattcgccgtccgcacgccggatattctccgctgagtcgttgcgcgcacgatggcgcagcggtgagccggtggtgacctccgcaatcattctcgtatgcgtggccgtgtggctgctggagaccctgttccggttcgtatggccggcagggcttgccggcatgctgggcttcggcatgatgcagccggcttcgatgacccgcgagccatggacgctcgtcaccgccatgttcctgcaccaaccggcgtcgctgtggcacatcggtttcaacatgctcacgctgtggtcggtggggccggtgctcgaacggctgatggggcattgggcgttcctgatcctgtacatggtctcgggcatcggcggcgatgcgggcatgatgatctgggcgctgctcaaccgctccggcgaggggtggttcacgtcgagctacggcgcctcgggtgcgctgttcggcctgttcgccgcgattctggtggtctaccgcaaggtcgggcaagacctcacttcgatgattgtgtggatggccatcaactttctcatgccggtcattgtgccgaacatcgcgtggcaggcgcatgtgggaggctttgtgataggcggtttgttcacgattctcatgaccgacggcgtgcgcgcattgcggcgtcgcccggtgctggaacgcgcgctgatctatggcgcggtgctgctggtgctgctgctcgtggtgtgctacgcctgcaataccgcgaatccgatgcgtaccggcagctggatcccgttcctcgactagttcctcgttccttggtctgccttggtctcggacgcgaggcgttcctcacccgcgtttacatggcactgcgatggcacggtgtgcggatgcttccgtatgccgtgccatttctgtagattcagcggtcgaactttcggaaggttccgcgaagcaggccatttcagggcatctttccggcagattgttcggaaggttccgtgagatgtgccgtcgcggggtgcattcgcggcgtatccttcggatgcttccgcagattgagccattcagatgcgaatctgtggcatattgtacggagtcttccgtgtgatatgccgttcggcgctcgcgggtgtcggtgcggctggtcggctgtgccaatctggtctcagattggcacaacatacgcgcaataccgcgtgacctttgcaaagcgagtcccgtaatgacaatgaagcggctcggctacagggccgtatttgcacgggcaatctcatattggtgaggaggcgggagacaacattgcctcacacggcattttattaggtaatcgacgtaaatatgtcgtgtgagaagaaggggtgagactgcgcagtgctcgacgcgccattgcacatgcgcggatctacaggtaccgcggcgccgcggtctggcaacggcgggcaaacaggtgttcgattgcggtgccgtaatctgcggagtagggaagtatgaattcgaacatgtgtttgagttacacgcatgtagttttccacaaatgtggaaaacgttgtggataacatgggtatagcgtatggataagtgctcaagttatccacatggttatgcacaatcggtgcaattccaatggtttctgctgtggaatattgtggacaacgttatccacaatgggcagcggggagtgtgggcaatctagaaataggcaacaagctgcacggtatgcccgtatatagtggcaaaataaggcaatttcggcatgttatgtcagaaacgcggactttgcccacaattgtggataacgatgtgcatatatgccggcggttacgcaccgcgcaacgcatacgtcggcttgcagctgattccgcgtcacgcactccgtcgcaggcggaatggcatgtggctggcgcgcatttcgcacatcgaggaaaagaccgcggcacatgagatggccaacgggtgtggcacgggtagtctcgtgggtatggcgaatctgcagatgtcacaggaaacacgcgaattcatacgcgcgcatgccggcgaagacgtgcgcgaactggcattgcacacgaaacgcgacgtgcccgggcttgacctgccgttcgcactcgaccagattgccggccgcgagattgcgcgcacgaaactgccgcagtgggccgcgtgcgagggcatcgtgtatccgccgcatctggcgatggaacagtgttcgtcgcagttcaccgcggaatacaaggcacaggtggcggcacagctggtggaggaggaaagcgagcccacgctggtcgatctcaccggcggattcggcgtcgatttcagcgccatggtgcgcggattcgcacatggcacctatgtggagcggcaggagaggctgtgcgaggtcgcgcggcataatctgcgcgaacttggtctcggcggtcgcgctgacgtggtgtgcggagacggcgtggatcaccttgcgcagatgccgccggcgacgttgatctaccttgacccggcgcgccgtgacgagcatggcgcgcgcacctatgcaatcgaggactgcacaccgaacgccctcgcactgcgtggacaactgctcgacaaggcaccgttcgtgatgatcaagctctcgcccatgctcgactggcgcaagaccattgcggatttcgtcggctcggttgcgcaggtgcacatcaccgcgacggggaacgagtgcaaggagattgtggtcgtgctggcgcgcggcgagcatgagcgcgtgcgggtcgtctgcgtgaacgatgcgcagcggcttgaattcgaggtcggggcggattccgcggggtcatggcagcgcgcggatgtgctggatgcgtgcgagctgggcgcgcagcggtacctgtacgaaccgaacgcggcgatcatgaaggcgggcgcgttcggcgagatcacgcgcaactatgatgtgcggcagattggcgcgaacagtcatctgttcgtgagtgagcacccggtggcagattttcccgggcgcgcgttcgagatcacggcgctcggcacgatgaacaagcgcgacgtcaggcaggtgcttggcggaatctccgcggcgaacgtgagcgtgcggaacttcccgctcactgtgcagcagttgcggcgcaaactcaagctgcgcgacggcggagacgtgtacctgttcgcgaccactgtggcgggcgggcatatgctgctgcgcacgcggaaactggcgtgagcgcgggacgggcgcagagtcgcgccgggcggccattgcgtcgggcgattatctttgcgtaaaaagagacagatagaggctctatatgtccccttttacgcaaagaagaaagaagggggagaagagaagaagaagagaaaaggatagggaaatcggttgttctctgcgtaaaaagggacagaattgactgtggtctgtctctttttacgcggagatagggtaaaaagaaaatgcggatatgccagccagatggtcagcgccaggcgactgtcatgaggaagccgatcatgattagcgcgaagccgacggccagattccagttaccgatgccgggaatcgggtatttggcggtcatgtagaacacgaccacccagatgaggcccacgatcatgaacgcgcagaacagcggcacgaaccagctcggattggccttcgtgcccttgatcgactcctccacgcgcttcgtgttctcctgctggcgtttgaccatgcggcgcatctgcggagacatgtctttctcgtcaatcgtggagttgagcacagcctggattttgtcgagcgagaggtcgtctgcctcctcctcggagaccaccgcggcctcctcggcgcgcttctcgttgtcttcggcgcgcttttcctcgcgctccgccttcttctcggaatcggtctgtggctcctcggtcaccgtctcggattccacggccacggcatcgccttcggaatcggtggcggcgtcgaccaccacgtcgtcggtgacggtggcgttgctgtctgcggcgtcgtttgccgagacatccgcgtcggttttgtgcagctcttcctcagccatttgtgtagtctcctttaatcggctaccagttatcatagtgggtatgtgggaaagcgggcccagggcgtccgcgacctcagcaaaacaaccatatttggaggtggcgatggcaaagcacggtgccaggcatgtcaggaagacatcggtggtggggagcatggccgtgcttgtggtggtcgcgttggtcgggtacctggtggtgacgaatctgcgcgtgaacaaatccgcgaccgtgtcgaacgacgccgcggaactcatcgaacaccgcgtgcagcgcgtggacgaactgcaaagcgaagtgaacaagctcggctcgcagatcgacgactacaacacgctgctgcgcaacaacgagatgcaaagcggcaacagcgaggaggcgggccaaagcacgatgctgcccgccgtgaccggcccgggcgtcaccgtgacgctgaacgactcgtcgatgtggcgcagcgcggtcgacagttccggttccaccgccgacatagacaagtacgtggtgcatcagcaggacgtcgaggcggtggtggacgcgctgtgggcaggaggcgccgaatccatgcagatcatggaccagcgcgtgctgccgacgtccgcggtgatctgctcgggcaacgtgctgctgctgcagggccgcaaatactcgccgccgttcacgatctcggcaatcggcccggtggacggcatgctgcagtcgctcgacgattcacgcgcgatccagatctacaaacagtatgtggatgcgttcggtctgggctacgacgtggaagtgaaccgctcgctcacattccagcgcacgccgctcgtgctcaatccgctcagatatgcgaaggcgttcgagtcgggcggctcgaacgaatctgcgaacggcgggcagaccacttccgccacgaattgaaaaccgatacaatacagagacttcatacagctacagacttcacacagacttccggaacacggatatgcatgaccccgaggaggccacatgaaacacggcggcaggcgtggtaacgcatccgcacggcaggatggacggattgaccgccttccggaggtggggggcaaacggagcgtcatgcggtcggtggtgatgatcctcgcggagattctgctcaccgtgggactggtgtgcgcgctgtacgtggtgtggatgcaatggtggacgggcgtgcagtccgagaaccggcagatcgaggaacgccagagcgtcgggtgggcgcagccggccagcgacggcgccaatgcgaaaatcgcgcacccgcagcagggcgaccctccgctgcaacccgaacatgcgagcataggcgagctcatcggccgcgtgtacatcccgcgcttcggcgatgcgtgggagcgcaatctcgtgcagggcaccgacctggccgaactcaatctgcacggactcgggcattacgtggactcgcagatgcccgggcaggtgggcaacttcgccattgcggggcatcgcaacggttatgggcagccgctcggcgacgtggacaagctgcagccaggcgacgccgtcgtggtgcgcacgaaggactactggtatgtgtacacctacacgaactacaccatcgtcacgccggacgagacgtcggtgatctcggcgaacccggaggacccgagcgcgccgccgaccaagcgcctgctcacgatgaccacatgcgagccgaaatacaccgcgccgacacatcgttggatcagcttcggcgaattcaagtactgggcgaaggtgagcgacggcgtgcccgcggaactcgccaaaaagggcgcggatggcgcgacgaagttcatcagcaacgagcagacgccgttcttcgcgaaactcaagacgctgcagccggtgatctggggggcgctcatcgcgtacgcaatcatcttcatcgcggcggcgatcgcctggcgctggccgctgctgcgtgcgattcgcgaggggcgccggcctcggccggatgtggacatctacggcgtgctcgtgcggcaccagcccggccccgcgccaatccgctggctgctcgcgctgttgctgttcgtggccgtgtcgctcgcgatcatcgaatgggcgtgcccgtgggcggcgagccatatcgaaatactgcgcgaaatgtcgaactacacagcggtgaacacgcagtagagcgagcgcggggtgcagattgcggcgtgctgcgcgcggctcgcttccttcggtccatgtgtttcctgtgtttcctttgcttctgctgcttccctcgcttctgctgtctttgcgtaaaaagaagacagatagggcctgctatctgtcttcttctacgcagtgatgaagtgatgagtggacatgcaggcgcggtgcggggtgcctgccggtagaatcggggcagacacagtgaggagtgagatgaccgattccgcgcgcattctggtgatagacaactacgattccttcgtgtacacgattgtgggatatttgaagacgctcggcgccaccgtgaccgtggtgcgcaatgacgcgctcgacccgcacgaagatggtgtgctcgacgactacgacggcgtgctcatctcacccggaccgggggcgccgagcgagtcaggcgtgagcgaggacgtgattcgcctgtgtgcacagaccggcacgcccatgttcggtgtctgcctcggcatgcaggcgctcgccgaggtgtacggctgcaccgtgagccacgcgccgacgatcatgcatggcaagaccagtctggtagagcatgtggatgatgagatcttcgccggcgtcgcgaacccgatgactgcgacgcgctatcattcgctcgccgcggagccggattccgtgcccgacgagctgcaggtgaccgcatggaccgtggacgaccacattgtgcagggtattcgccatcgcgaactgccgttgttcgccgtgcagttccaccccgagtcggtgctcacgcaggatggctacagattgtttgcgaactggctggccgtgtgcggtcaggagtctgcggtcgagaagagcctcggcctgcagccgaagctcgcggccgagtagcgcggctttcagggccctgccgggacggcaagaggtcgtcacgggatcgctgcgcgccctttacgttcctcatccttgccgccccggcagggccacggcgctacgcgcggcggataatgggcaggagcgtaaacaacgacgtaaaaagggacggaaccatccttcatatgtcccctttcacgtcgtctttttgcgtaattggagacaagttgaagctgatttttgtcccttttacgcagttgttatgcgtaattggggacagtaccgagggtggttctgtccccatttatgcagatggaagattcggcgctagtgtttgttgtcgctgttctgctggttctgcgaggactgggagccgctgttgctgtctccattgccggagttgccgttgctcccgctgctgccgttgctattgctcggtgaggggctggggcttgggctttccttgggctcagtggtgagtgtcacctcggtacctggattgacctgagaccctgcgctcggattcgaggctgttactacggcatcatcgttgtctttgctattggctgccaccttccacttgaggttgagagccgaatcggtgagtgcggccttggcttccccgagtgtacggcctacaacgttcggcactgctaccttgccgttcgacacccagatggtcacggaggcgcctcgctccaccgatgtgccctcgttcggctcgatgcgcgtaaccgtgttctcgggctgtgacgagttctcggtgttgatctccacggcgaaaccgttcttctggagctcgtccacggcctcgtccttcgacttgccgatgagcccgctcggcaccttcgtcatgccggacgacacccacagactcaccgtggttccctgctcagcggaggtgccggctgcggggtcggtgcgtgtgacatggtcgcgttcgattgtggcgctgtcttcggtctgcacactcgaattcacctcgaaaccggcggcttcgagggcagctcgggcgtcggcctgggattggccggtgacattgggaaccggcacgctcttcggtccggcggagaaccagacggtgacggtgctgcccttctccacgctgcggccgccggcaggtgcctgcttcgtgaaggtgccggctggctcgcgcgaatcggtgtcctgcttgatcgatgcctgaagtccgagctccgcgagctgtgccttcgcgcgttcctcggtggttgtggccgagaaagtgggcacggtgacgtactccttcttcggcggttgcatgtgcgcccacgcataccatccaccggctgcggccagcgcgagcaccacgagcacgaccacggtgatgattgtattgcgtttcctcttacgcgccgcttcaagacgcttctgtgaccggctcttcaccattgtgtcggtgtcgccggccgcagcattcggatcctgcggcaccgtttggaactggcccgtcaccgggttgtacacgcgtgtggacccctcgttggcggggtagtcgttcgccgccgccatcgtctgcgtcttggtcgcgttgatcgtggagagatcctgcagcgggttgaacgcggccgccgagggcaggccgccgttcatgtaggtgagaatgtcgttcttgaactcggtggctgtggcatagcggttctggcgatccttggccattgccttcgccacgatctggtcccacatggggttgagcccgggcacaatggaactcggcttcgccgcgacttccgaaacatgctggtaggcgatcgccaccgccgaatcgccggtgaacggcggtctgccggtgagcatctcgtaaagcacgcagccggccgaatacaggtcggagcgcatgtcgacgttctcgccgcgcgcctgctcgggagatagatactgcgcggtgcccacgacgccctgcgacttggtcatcgtggtggcggaatcgtcgagcgcgcgggcgatgccgaagtccatgaccttcacaatgccctgctcggagatcatgatgttgccgggcttgatatcgcggtggatgatgcccatgcggtgcgaatattcgagcgcgttgagcacgccgatcatcacatgctcggtgtcggagacgctcagcgcgccgttcgccttgatgatgtcgcgcagcgtctgcccctgcacatactccatgatcaggtatggcaggtgttcggtctgcccgttgtcgagcgtgaccacctcttcgcccgaatcgtagatgttcacgatgttcgggttgttcatctgggccacggaatgcgcctcacggcggaagcgggtgaggaagatctcgtcatgtgcgaggtcggcgcgcatgatcttgacggcaacggtgcgacccaggcgtgtatcgagtgcgatgtgcacctcggccatgccaccgcggccaacgagctggccaagctggtagcggccgttatcgagcgtggtaggcatgctactcattgatgctccttccaaagcctccggcgatcgcatggccgggggaatcggtaccggcatcgcgctgcgtctgctgcgcgaacgggaaggcggattgatacgtttgcaggtcatggtgcggtgcactcgtgacccggcgggggactcgtccgttgatgttcaccatggtggtgtcgctcagcgcggtctgctggtcgagcagacggcgctcgatgcgggagagcacacgcgccacggtcagcgcgtcctgcggacgatccgcagggtctttcgcaagcatcgacatgacgaattgggaaagctggaaatccacggtgttcggcaacgggggcaccggattgttcacatgggcggcggcgatgtcgaccggcgtcgccccggtgaacggacgatgcccgcacaggccctcgtaggccacgacaccgagcgaatagatgtcggactgtggcgtggcctgctggccttgcgcctgctccggcgagatgtactgcgcggtgcccaccaccatgccgtcctgcgtgatctgctcctggttcgtggagtaggagacgccgaaatcggtgattttcacttcgccgttgtcggagaccatgatgttcgccggcttcacatcgcggtggatcacaccatgcgagtgggcgacgaacagcccgcgggcggtctggatgagaataggcagcagacgaatcgggtccatggggccatcaagctcgtggtagaggtctgccaacgacttgctcggcacatattccatgatgaggaagccgatgccgtcgtgctcgtagtattcgaacaacgcggcgatgttcgggtgcgccagattggcggaattgcgggcctccgcacgcaggcggcgcagtttggactcctggttcgtcgtgtctttgcgcagcgccttgatggccacgggacgaccgagctgaatgtcgtagcccttccacacctcgcccataccgccctgggccagacgcgagtcgagacggtaccggcaatggatgagttgtccttcaatcaatctcattgttggagcgcctccttcataatcgcggtcataatcggtcctgctgcaaacgagccgtagaggtcgacattgtgcaccaccacggcgacggctatcttcgggtcgtccgcaggcgcgaagcccatcacccagccgtctatcgagctgttgttcgctccgatctgcgcggtgccggtcttcgccgccaccttcacgccggggatctcgagattcgggttcgcgtcggtcactacggcctccatcgcctcggtgagcttgttcgccgtgtccgcactgaacgcggtgtccatcacctgcggtttcgtgtcgggcatcaccgagaggtcgctgaaacgcacgcggtccacgagtgtcggtttcatcaccttgccgtcgttcgcaatggcagcggcgatcatcgcgttctgcaacggcgtctccaccgtgtctccctgacctatcgaagccagcgcgagcctgtcgtcgcccacattggtggggaatcgcgaggccacggcctgcatgggaagaccgttcgaatccgtgccgtcgatcacgatcggcttgtcgaagccgaacttcttcgccatattcgacacgctctcgtctccaagggccacgccgagctgcgcgaatgcggtgttcgacgaccacgccatggcgtctttgagcgagatcttgccatcggtgccgttgcccggctcctcggcgttcgtcagctgcgtctgcgtgcccggcagcgtgtatgaggcgccggccggaatctgcgtgtcgagctggtatttgccgctgtcgagcgcggccgccgccacgaccgtcttgaatgtggaccccggcggatacagctcgctgatcgcacggttgagcatcggattgctcgggttcgtgacgagttcggtgtacgccttgctcaccgagccggtgtcgtgcgaggccagctcgttcgggtcgtagctcggcgtgctggccatcgcgagaatgcgcccggtcttcggctctatggccaccgcggcgccgtcgttgttcttgagcgcctccattgcggccgtttgcagcttgggatcgatggacgtctcgatgctggcgcccttgttctccttgccggtgaacaacgccttgacatgctgccagaacaatgcgttcgattcgccggtgagcagctcattctcggaggcttcgatgccgcggtcggcgttctgtgcgatcgagaaatacccggtgattggcgcgtagatgtcaccctgcgggtaggagcgctggtaggagaacgaatcgttcaccgggtcggatttcgcgataatcgtgccgtccgacgccagaattgagcctcgcggggcaccgtacgtctggtatagcgcgcgtgtgttcctggaatcgtgggagagccggttcgcgcggttcaccatgatgatcgagctggagatgccgaggatcacgaacagcacgatgaccgccgtgaacagctggcgcaatgtcttattcatgctcggcacctccttcgcttgtggttgcttgatggttcgttggcgtatggggctgctgtggcagcggtggcacgctcggattcagcggtgccatggcctccgtctcctcgcctgccgatggcgtcgcctgctgcggcgacaccgggatgttcctcgtgttggacaccggctcgcttgtctgctgcggcgcgacaatcggttgcggtgagaccacctgcgttgccgaatcgtcttgtgccggtgacgcactgacggctgcagattgctggacggccgccgaggtgaccggcagctggctcgtacgcgggcgaggctcctcctcgcggttgccgcgcggtttcgtgacctgcgtggcattgccggatgccttgcgctggcgcggcttgcggctgctcagcgcgtgcacggcctccatgcggaacgtgtcggtcatcaggtcgttctgcggcttgttcgcggcgttcgagatgatgatgagcagggctgccagaatgtagttggcgatgagcgaggagccgccggcagccatgtacggcatcgtgagaccagtcagcggaatcacgagcgtgatgccgccgaccacggtgaacacctggaatgccatcgtgaacacgagtcccgaggcaagcagcttgccgaagccgtctttgatcttcatcgccgtgatcatgccggccgcgatgatgagcaggtacagcatgagaatcgcgaatacgccgacgagaccgagctcctcaccggccgacgcgaagatgaaatcggagttggccagcggcgtgatggccggatgcccctcaccaaggccggtgccgaacaggccgccggcggcgagaccgaacaggccctgcacaatctggctcgagccgccggggtaccggttgtagatctcggagtcgaaggggtgcaaccaggcgtcgacacggtagcccacatgcgcgaacaggtgcgcggccgccacacagcctatggcgaaggcgaggaagccgatgatgagccagctcgcgcggccggtggccacgtagagcatggcgacgaacatcgcgaagaacatgagcgaagtgcccagatcgtgctgcagaatgagcacgcccatcgaggcgacccacacgatcacaatcggtccaagatcgcgcaggcgcggcaattgcaggcctaacaccttcctgccgccgacggcgagctggtcgcggtggttgaacagatacgaggcgaagaagaacgcgaggaacagcttcgcgaactcgcccggctgcagctggtaggagccgacgccaatccagatgcgcgcgccgccgatctcacggccaagcccgggaatcatgggcgaaagcaacagcgcgaggccgatcaccatgctcacatacgagaatctgcgaagaatgcggtaatccttcatgaaggcgaacagggcgtagcagcagacgagcgccaggcacagccacatcatctggcggatggccacggcggtgtccatctcgccgtcgatgcgcgagatcatgagaatacctatcgatgtgagcatgagcacgcatgcgaagatcgactggttgccaaacttctggaaccggctcataaggccccaggccactaggaacatgatcgcgcagacgatctgcatgaccacgctgccggacgtgggcttgccgttcatgcgctcggacaactggaagaagccgagcgcggagatgagcagtgcgaagatgatctgcagaaggtaacgaacacgagcggccataatcacctgctttgcgccgacttcgtcggggacttgctgtcgttggcttgcttctgctgcttggccttggcgtcggcgtcttccttcgccttctgttcctgctccttcttcaggtcgttgaactgcgtccgtatgagctcgacatggctgagcgcctcgtcgtagccatccacgcttatgccctgccgcagacggtcctgccactgctcgggcagctcatcgaccttgaggtcggtgtgctcgatggcatgcgaaagctcgtagccgaagatgttcgttggcacgccttggtacacggtgaccacaccattgtcggaggccaggtaatattgcgtctggctccacgcatacgcggcccacgtgcccagcgcgagcacggccacgatggccacggcgactacactgccaatgatcttgccgcgaaacctgcgcgaacgggcctgcttcttctcctgcagatgctcgtggtgaatggccctggcgacctccgggtcgttcgggtccgcgctgtaacggccgtcggatttgcggatcaccggaatctcgccggtgtctggatcctgcagttcgccgttctcctcgcgcaccgtcgacggctgcgccacctgctgggtggcgtcgtgctcctcggattgcgcggccttgttgctgtcgctcgcaatcagcgcggcggcacgctccgccggtgacgagcgtgtgatcagcgcgggggcggacgcgacgggttcatgaatgatgtctgcaatcggttcgagcgtcgcgctggcggcaccgccgatcaacggagtctgatgcggcagatcgaacgagtcggcatccagggcgatcgtggaatctgcgatcacggcggacacattgtcggtgctccccgccttcaacgccatggaaaccaaggtctgcgcgcactcctccggatcggtgaaatgcgagagcgtctcctcgatcgtggaatcctcgagcacaccgcacaggccgtcggaacacagcaacaggcggtccccggcctctgcgcggcgaatcgagatgtcagggtgggcgtcgatgtcgaaatcgccgagcacgcgcatgaccacattgcgctgcgggtgattgcgcgcctccacctcattgatgcgcttcgtgtcgatcagatgctgcacatagctgtggtcggtggtcagccgcatgagtttgccgtcgcgcagcaaatacgcgcgcgaatctccaatatgggcgatcacccagtaatcggagacgagcgtgatcgcggtgacggtggtgcccatgccggcgagcttgcgttcgcgtttcgccttgcccacgatggcatcgtgcgcagcaagtgtggaggcctcgatgatcgccgccgccttggccacgtcgccgcccgcggaatccgtctcgatatgcgccagcgagcggatcgcgatggtggaggcggtgtcgccgccggcatggccgcccatgccatcgcagacggccacgagatgctcgcccgcgaacgaggaatcctggttgttcgagcgcacagtgccgacgtcggaaaccgtggtggaatacatatacaggtctgccactcgcggtcacctcaattcgaacgtggtagcgccaatgcgcaccggtacgcgcgggccgagaatggtgggtgcggagatgcgctgctggttcaccacggtgccgttcgtgctgtgcaggtcttcgatggcccagactccggtgttcggatcggggtacacgcgcgcatggtggctcgagacgaattcgtcgtcgagcaccaccgtgttcgaggcggcgcggcccagcgtgatcaccgaggagttcagcggaaccgaggtgccggcgagcgggccgtcgatgatcaccagcagcgtaggtgtgggtgcggtgtccgaaggcgcggccgccgacggtgtaggtgcggagacaggcaacggctgggccgacgctgacaccgccaacgcgtcgttcgatttgcgcacttcgcgctccttgcgcctacgtgcgcgggatttgcgtgggctgaacgcggcgacatcccggtacagcgaacgcgtgatgaaccacacgaacagccataacagaatgaggaacgcgtatttcagtaccgcaaaggtaagttcggtaatcatggaaaaatcccgctacgctcacctctggtcttgtgaggaggcccagtacaggatgcgggtgcggccgatcgtgatcgtgttgccatcgagcagcgtcgcggcgggaacctgatggccctccacatacgtgccgttcgtggagcccaagtcgcgggcgatcacaccgttgtccgtgatgtcgatctccaggtgtttgcgggagatgccggggtcgtcaatcacaatgtcgcagcccgagccgcgacccagaatcgtcttgtctttggtgagcaggtattggttgttgttgacttcgagcatcgggcagtcctcggcctgctcgtcagtggtgaccggtacggcgttgccctgcacggattcggacgtgagcttgaagttgcctttggtcagttgcaggtcctcttcgaaaataacgacgaccgggcccacaaatgcatagtgttggctcttcgcgtactgcgtgagattgtcggccagctcattggccatggcctcggaaccccagctttcgatgcggtcgaaatcgggtgtgctcagtttgaaacggtactcgttcggcgccacggtgcggtctcggccgaccggcatggcctcggcgtcgatttcgcgctcaagcgcgctggagagatcgacgggctgcaggtctttggagccgaacttcgcgaacactccgttgaccgcaccctccacgcttttctcaaaacgatcaagaacgctcatagttaccctttctatccttacctatcctacgcttatatatcaaccgtgtgaattttcaggcgcatcggtccgccgcgttttcctctgggagcgtatggattgcaacggtttgccgtttcactgcacgcatacggccccaccttgttcccgcggtttccacattgcctactatgcgccggacccacaggaatccgcaatcgttcggccgatgtatttgcggtctgtattgcggatgcttccgtgagcggtgccgcggagagccttggagatggtctggttttcggaaggttccgtggagtggtctgcagatgtgtccttaggcggcagatcttacggatggttccgtatgctgtgccgtaaatcagcgctgccgtggcatggttttcggatgtttccgtgaaccatgccgtaaatgggtgccgttgtggccgaatctgcggatgtttccgcaagctgtgccgtaaatcagtgtcgccgtggtcagtctttcggatgtttccgtgcaatgtgccgcggggaaggtcatctgtggtctgattttcggatggttccggaaactgtgccgccgatggggcttccagtggtcagatttacgggagcttccgtgagctgtgccgccgggagagtcgccagtggtcggtattgcggaaggttccgtgggaggtgccgcgggaaggggagtctgcgacctgttttacggaaggttccgtgaagcaggatagagtgggaacgaatagatgatccgatgagacgagaggtgcgggatggaatctgcaatcgaagaatacccagtgcgcaaagcgaaaacggtgcggttcacatgcggggcgccgcgctctcccaagctcatcggcgacggatcgcgcatgctgttcctacggtccgcgggcgagcaggacaccgagaattcgctgtggctggcaatctgcggggaagacgcgtatgccgaagtggagctcgtgaacgcgggtgagctcgtgaacacactgggcagcgacgacgtgcctgctgccgagcgtgcgcgtcgtgaacgtgcgagggagagcgccaccgggatcgttgcgtactcggtggacggtctgggcaatcatgtcgccttcaccgtgaacggcgagctgttcgtgacgacaatcgattgggacgcgctcgcgtacacggtgggagatgacggcgtgcgcgcacaggtgggcgccggcgtgcgtaccgagcatctcgtgccgcagttcgcagattccgcgcagaacgagttcgccggccctgtgctgaacccgcggatgagcccggatggcaagcgcgtggcatacgcgacgggatccgcggtggtcgtcgtggatgtgcagaccgcagtggcgaacgcggtgttcacggtatcgccacaggatcgcgagacgatgcgcgcggggctcgcggaattcgccgcgggcgaggagatggatcgctacgacgggttctggtgggggccggattcgcgcacactgctggtggagtgcttcgattcgtcgcccgagccggtgtggacgatcagtgatccggcggatccggcggcgcgcggcatccaacaccgttacccgcgtgcgctcaccgagaacgccgtggtcgatctgttcgccgtgcggctgggcgacgacggcacgtcggtgcagaagacggcgatgatcgactgggacaatgtggcttacgaatacctggccgtggtggattggcaggccgagcgacccgtgctgcgcgtgctcgaccgcttgcagcagcatgagcagattctgcgcgtggccatgccagcggagaacgagtggggcgatctgcgcgcactcgacggcaatgtgatggcgttgctgccggtggaggtgatcgccgagcatcacaacgaccagtggatcgatctggtgggtggaacgccgtgtgtgacaccgtccggtgccgtggtgtgttcggtgaacgacatggaggccgacacgaatcggttgagcgtggatggacgtgtgttcacgccggcggggtggcaagtccgcgaagtgctcgacgcgggtaccgacgatgtgttgtgcgtggtgcagcgcacggccgaacgcgccgccgaggtgccggagcagtgggcggattccactgccgaacgctaccatgacgcgcgcagtttcgacattgtgaccatatcgtacgccgatggctcggtgcgcgcggtgagcgacgagccgggcgtgtggcgtgcgtcccgacgcggcgacggactcgtggtgtgggggcgcaccatggattcggcgaaagcggtgatgcgcctgtcatacggggctgagggcgcgcgtacgggccacgacgtgtgcaatgtcgccgccgaacctgacttcgtgccgaacgtgcgcttcgtgcgactcggtgaacgtaagctgttcacggcgattgtggcgccgagcgcgtcgagccggttcgccggcgccgccgagctgccggtgctcatgcatccgtacggcggaccggggcaccaggaggtggtcatgagccgggccgcctacttggacgcgcagtggtgggccgaccagggctaccttgtggtgattgcggacggccgcggcacgaccgggcgcggaccggtgtgggatcgcgaagtgtatttgcagatgaagcgcgtgagtctggccgatcaggtggacgcagtgcatgcgctggccggtgcggtcgacgagctcaataggatgggaggcgcggccgagggctgcgaattcggtgggcacgacgatgctgcacggccgttgccgaagccggatctcgagcgcgtggcgatgatcggctggtcgtacggcggattcctctccgcgctcgcggtgctcgacgccccggacacgttcgccgcagcctgcgcgggcgcgcccccgactgactggacgctgtacgacacctgctacaccgagcgcttcctgggcctggacccgcaggtgtatgccgacaacagcattgtgttggacgcgccgaagctcgttcgaccgctcatgctgatccacggcttcgccgacgacaacgtgacgatcgcgcatagcctgcggctgagtcaggcgctcatggaggccggccggccgcacaccttcctgccgctcaccgggatcacgcatatgacgaacgacccggatgtggcgaggaatctgctgattctgcagcgcgacttcctgtccgatgccctcgcgaggtaggcataccgggcgccgcccacccgtccggctgtcacgggctattgaaccaggaaactcatgatgaggatcagcacgaatccgacgatgtcgacgggggtgaacaccgagccggtccacaacaccgacgagatggtggcggtcaccggctcgatcgtcgccagaagcgtcgcgcgcatcgagccgatgcgcacgacgcccgccatgaacagccagaacgcgaccaccgtgcccacaaccaccgtgaaggccatgagccaccagccgcgcgcgtcgaaatgcggcatgttctgccatggtttgacgaacggcagcaatatgagtccggaaatgaggaaagtaaggccgttgaaggtgagattgccgtagcgggcgatgagccccaccggaatgatggcgaggcaggcgcaggagaatgcgtccataaggccccagaacaggccgggcagcggcatcgacagcgtgctcagcttgccgccggtggccagcagccacacgcccacgaacgccaaggcgacgccgatcacctcgcgtttcgtgggcctgcgcttcgccctcacgcacacatagatgagcaccatgagcagattcaccgtctgcagcacggtagcggtgcccgcgttcgtccaatggatcgagaacaggtaggccacctgcacgagcgtcacgcaggtgagcgccgcgcccacgaacttcgggtattcacgccagctggtcaccgccgacctgagcgagtgcggtgtgccgatcatggcggccacgaggaagatgatccccgcgatgatctcgcgcacacaggcgatccacagcggagccgcgtggtattcctccatgaggatcttcgacaccgcgccattgacgccccagcatgtgccgccgatgagcacgcatgcaatgccgatggccattttccgcggcgtctgctcgaaggagggcgtctgctctcctttgcccgacaccgcctcctcgacgagcacgtcgcgcgcatcagcctgctcggtggccgccgaccgcgccagcatctcatggagttcctccggcgaattcacattgcgtgtgccgtggtcgtgctgtggatcgctgtgttcagacaccggggctccttccgctcatctctcgcacgcatagtatcgcgcaggccgtgaaataccggccccggcggcgcgccccgcccgagttcagacgagcacggtgaccggctcgctcgtttgcaggaacgtgaggatctccttcagatacggtgccatcacgctgttcggcatcgtgaagatctcatgcacggagccgggcacgcgaaccatgcggatgtcgccgccgtccttgcccacgcgtttgacgaagcgattctgcgccttgttgcgcacccagtggtcattgcctgcctggaacagcaggattggcgtctcgatgcgctcgcacatatgcgggtcctgcatggcgatggacaggcggatcgcctgcctcacccactcgttcgccgcggccgaggtctggtaatgcgtgtctgcgatgcgcagcttcttcatccattcgagacgctgcatgcatgcgccctggttgtctttgatgtcgatgagcggcgtgaacgcgcgctgtccgggtgccatggacttggcgtggccgaaatcgcatgccgcgccgcacaccagtgctgcgagccagttcggggtgtgcagattcgcctcgatcatcggcgacgacagcacggccttgtcgacgatgttggggtaccgctcgagcatggccgctgcgatgccgccgcccatcgaatgtgcgaacagcacaagcggcttgtctgccgccatcgggcgtgcgatcgtccgcgcgcatttcgcgagatcggcgacatagcggtgccatgtgtcgatgtacacaatctggtcgttcctcacatcgcgcgcggaatagccatgcccgcggtgttcgagaatacaaacggagaatccggcgagcaggaagtaccatgccatctccttgtatttggccgcgaactcggtgaatccgtgcgagatgagcacggtgccatgggtttggcgggaggagccgggaatctgcaaggcatggaatttctcgacgtcgtagcgcacgacatgcagcttgttcggagtgccgtccgccgggtgcagcgtgcgcagtctgtgcccatgccaatccgagacggccgggtccatgtagccgtcatgcatgcacgaatcgagggccggcagggcggtggcctcgagatcctgctggaattcgtgttcgttgatcatcgcgatttccatgggctgcctttcgtcgggtgaaactgaagaccagcgtagtctgcgcgtgatatcacgtgaaatattcggctgtcagagtcgaaaacgcgtagcgcggtgcgcgtaatcagggcgggggcggggagggtgagcctagaatctgtggaagaaatacaggaattttaggaaaggaagcgtcatggtagcgcagaacatcatcatgacagtcctcaacgtgatcgtgctggtcgcgctgctggtgttcggtgtgtacgcggtgtacaacaacaagccgaatttcgagctcacgccggcgcatctctatgaccagcagatggggcagaaatacggcatctgggtatttatttgcgtcatcatcagctggctcgtcacgctgcccggcctgttcgggccgctgagcaacacgtggaaccagattctgtggtgggtcgagctcatcttcaacatcgccacgctcgtgttctgcgtgctcgcgtcgttctactacagcaggctgaacacgcgcccgcacgactgaccagccgttccacaggcctcctccgggaggcttttttgttacgatgtgctgggattccacggtgtgacgggaggtcgcgatgagtccggagaaattggcgcggtttgcggattcctggaaatacttcgtgtgcccgctgtgccgtgaggagctgcggctggagggtacgagtctgcgttgcgaacgcggtcacacctacgacgtggcgcggcaggggtacgtgaatctggcgcccggtgcgcggcagtcggaatattacagcagagagtcgttcgagcaccgcgggcagattctctccgccggctattactcgcatatcgtcgacgccgtgctgagtgccgtggggcggtattgcgggcagattgccgcgtccatcgatttcgcgggcctgcgcacgcgttccggcgcgcaattgcgcggcgcacgcgggcgtgcggatctgcgctcgagcgggccgcagatgcgcgcgccggtgatactcgacgtcggctgcggcgaaggattctatgcgcgcgccgtgcaggcggcgcatccggatgccacggtgctcgcgttcgacatctccaaggattccgtgcagctggcggcgcgcgaagacgcggggtgcgcggtgaggtggtttgtggggaatctggccgaactaccggtgcgtgacggcgccgtggactgcgtgctcgacgtgttctcgccggtcaactacgcggaattcacgcgcgtgctcggcggctcgggcgtggtgatcaaggtggtgcccggcgcgcggcatgacgagcagctgcgcgagctcgcacgcggccagctgcgccacggcgactattcgaacgagcaggttgtggggcagttcgccgagcatttcgatgtgctggaacgccggctcgtctcccagaccttcccgatgccggccgacgatgtgctcgccttcgcccgcatgacgccgttgctgttcaacgtggacgtggattcgcttgatctctcccggattcatgagctcaccgtggaggcggagatcctcgtgggcagcgtgtgcgggtgattgcgggggagatccatgactatagcgtgattatagcgtgattatagatggttctggtcatacccacctctgcgtaaaaagagacagaaagatgcacaagatgtctctttttacgcagagttgcagagttgcagagttgcggatttgcggatttgcggatttgcggagtgcacaggttttcgcctgcgtaatttgggacatgttgagggagcatagatgtctctttttacgtaaattttggaagatgccgtcgccgcggaatgcctgaaatgcgtcactgtcttgaattgcgtaatttgggacagttagccggcctaactgtctctttttacgcagattatgttgctgcgtgcagctttgtgtagcttccataggttccagcttgcgtaatttgggacatataaggagtgcagatgtctcttcttacgcagacagtgagatagtgttgggggctgtggcccccggtggaaccgcagcccccaatgatggctacaagtgaggtcagttctttgctgaagacctcatgaggaagaaggaaaccactgcgacgacgacaatcgcgccgatcaacgacggaatgatcgccatgccggcaagctgcggtccccagtgacccaacagcgcctcaccgagtgcagaacccactaggccggcgatgatgttgctgatccggcccattgcaccgctgtgatgcgtgatggcgccggcgattgcaccgatgattgctccgacaataagaacccataaccaatgcataattattcatattttgggttatatatacggatatttgggattgtaaaatgcgcgactgcgggtcgtgtttatttgggctatgaggtgaaactatgcagttttgagataaaacaaccacatgaaaatttgcagtgtgctacacgcttcgcatatcataaacgagcgtgaatattcagtctttattcacggtgtgcatcagctcaggcatgaaaaaacggggcgccggttgagccgggtcccgcgaatccagattattgagttcggcagattgctatgcgcgaaccttcatgacgatgaagctgacgatggcgaccacaatgaccgcgccgaggacggacggtacgaccgccatgcccccgagcgacggcccccaggagccgaagagtccctgaccaagcgccgaaccggccaatcctgccagaatgttgctgatccagcccatcgaatgcccgttgttggtaatcgcacctgcgatcgctccgatgactgcgcctacaataagtgtccaaatccaaaacatggtgtccattctttcagttgttgatgaaccaataccttcactctacgggaggtgcgacggccgcgtatcgctttgtgctgtggtgatattctgttttgtttggaattccgccgttttgagcgcgcagtaggtgcgcggtgcccgacggtgtccctgtgcacgggtgacgttcaggaagcatgcctgccggtgtgctacgcgcgcaagtcccgggtattcgtgccgtgtggtttgcgggatgtcattatttcttacgggatgtctggtccttgatatcgttgtgcggaattgtgcaaagagtgcatcagtatggtgttttcctctctctgtgtgttgtgaaatggtagactctatcgccgaaatcagcgatgccatgagagtccagacatcccgtaaagaatagtgacatcccgtaacggataatgacctgtggtggtgggggtgttcccagatggttctcgaatggccctcagacggctctcgaattttgctaaattgttgccgaaacagcccccgtcggcaaagcaaaacggctgacttcgttggaaatcagccgtttcttgctagtgcgagcggcgggacttgaacccgcacgagcatgagctcactgccacctgaagacagcgcgtctaccattccgccacgctcgcagacaaagagttagattacaccaatgctcacaatagtgcaattcggcgtgttgcaacacgatcatggaaacgggcgccggacgctcgacctcgcgaacgcctggcacccgcccgctgaacatctggcgttcactcgccgtgtgcgagtgcgcggaactggtcgggatcgatcactttcttgtgctcgcggccctccttggctccttcggcacgctcgtacgcgtccacgcgcttccagccggcgaaatcgattggtcgcacgccgcgttcggcaagcagacggtcgatcgactcggggtcgcggtcgggcgcgagacgtgcgttctccttgttctgtgcgaggtcttcgagcatggccgtcacgatcatcagcgcgtcggacttcgtcgaaccgatgagtcccaccggcccgcgcttcgcccagcctgtcgcatagaggcgttcgcgcacttcgccgttctcatgatccacagtgatgcggccgtcgccgttcgcgttggccaaatgcgcgccgccctcgtcgtaggcgatgcccggcaccgattccggcttgtagccgatggcatggtacacggcctcgaccggatagtcggtgaattcgccggtgcgatgcatcttgccgtccgcgccggtctcggtgcgctccacgcgaatgcctctcaccttgccgtcttcgccgagaatctcggtgggtgcggaattgaagtggatgtagtacttgcggtcggccgggttgccttcgaagtcaacgtcgccgtcgtcttccatgtcttcggccatgtcgcgaatcacgaacagctcctccaccatctggcgcgtgagcttgtctttgccggcctcctcgacggtgtcgtcgtcgagttcgaagtcgtcttcgtcaatgatgagctgcacgccgggcagtttctccatttcgcgcagctcctgcaccgagaacttcgcctgcgcgacgccgcggcgaatgaacaagtggagttccttcgccttgttgttcttgatgccctcgtacacgttgtcgggaatgtcggttttcgcacgcagatcgtcggcgttgcgcatgagctcgcgcgcgacgtccatcgccacattgccgccaccgatcactgcgacgcgttccgcttcgagcggccattcgcgcacgccggtcgggtagccgtcgtaccactccacaaagcgcgcggcaccgtacacgccgtcgagatcggcgcccggaatcgcgagcggcttgtctttgatcgcaccggtcgcgaacagaatcgcgtcataccgctccagcagatcctcgagcgtcacatccttgccgaactcgacgtcggcgtacagatggatgttcggattatccagcgttttctcgagcgccgatgcaatgaatttgatcgacggatgatccggcgccacgccatagcgcacgaggccgaacggcaccggcagtttctcgaacagatcgatgcgcgcgtccgtgccgagtccgagttcgtcgccgagcttggcgagctggcgcaggaagatgtcggaggagtagacgccggccgggcccgcgccaataacagcaatacgaagttcagaatcttgagtcacgagaatagattagcccacactcgcgaatctgtgaagagtcgcgcacttgatttatctcgctgggggaagggctggggagacaaaccagtgcgaatagtgtcaggttcgtctcgctgagaggagggctagcgtgacaaacccggcactgcgtacttgatttgtctcgcagatttcccggattgagacaaatcaagtacggatgccagcatgactcgcttgcttgcggttgaacagtgccgtcagagcccacagaatggagacgacgtcgatcgcctcctgcaggaacgcgccgacgaccacggggattaggttgaacgcggcgcacaccatgcccacgatcgcgagcgcgatgccgatgagcacggcctgcagcatgcgctgtttggtctgccgggcgatcttcacgccgagcggcacggcgccgatgtcgtcgttcatgatcaccacttcggcgctttccgaggcggccgtggacgtgccgtcggtcattgccatgccgatgtcggcgaccgcgagcaccggcgaatcgttcacgccgtcgcccaccatcatcgtcacatcgcggtgaatcggttcgccgagcagcttcgccaggaaacgcttccagcccgattcccggccggtcttctcggcggcagcggcctcgcgcacggcattcaccttgtcttgcggcagcagttcgtagcgcacgtcggtgatgcccacttcgtttgcgatgatcatggccgacgccttcttgtcgccggtgagcatcgtctcttctttcacgccgagctcgcgcagttgggcgatcgactgcttcgcgttgtagcgcggcacgtcgcgcagcacgatgcgcgcggcgagcttgccgtcgatggcgatgtacgtggccatctcgtcgggttcgagctcggtgggccacagtttcgccgcctcgcggtccgcctgctccatcgccttctcgttgcgttcctcttcctgcgcggtgtgcacttcctcgctggcgatggattgctccgtcacgaaggcgaaacgccccacctccaccttgtggccgtccaccgtgccggtgacgcccttgcctggcgtctcggagacgttgccgaccaccgggtagttctcgttggggttcggcagttcgcgctggcctgcaccgtcggctgcggttttgccgcttgagctggggagtctgtgcaagcgtgccatcgcctccttgccggcggcgacgattcccttggcgagcacgtgcaccgagaatccctccaccatgccggcgagcatgaggatctcgtcctcggagacgttcgcaggcatgtccttggccttttcgacgcgcaccacctgcggctgcttgacggtgagcgtgcccgtcttgtcgaagaacacatgcgtgacgcgacccagattctccagcacatcctgagatttgatgagaatcttctgcttggcgaggcgtgcggtgccggcgacgtacgcgaccggcgcggcgatgagcagcgggcatggcgtggcgagcacgagcacctgggcgaagcgcagaccggtgcccgagacgatccacgcgacgattgcaatcgcgaacgagatgatggtgaacggcacggcgagcatgtcggcggtgcgcaccacggcggcgcgcgactcctccgcggacgagacgagcttcaggatctgctggtactgcgaatccgcggcgagtgacgtcgtgcggatcatcatcgtggtcgagccattgatggagcccgagagcaccttcgcgccgacgaacagggtgcgcggcaccggctcgccgttgatgttgctcaggtcgacgcttgcggtgccggagagcagctggccgtcgaccggcacaatctcgccgggtagcacgatgagcaccgagccgagcttgacgtcgttcaccgggaccgtgtcgaaatgaccgttgcccatggtgatcggcttgccttcgcgctgcgcctgctcgacggcctgctgcaccttgcggaagccttcctcggtcagttgcgcctcgccgccgtctgcaacgccgggcaatgtgaccacgtgcgcctgttgcggcgccgctttgatgagtgcggtgagattgccgcgcgccttgttctgcgcgtacgattcgattgcctcgccggaggccaccatgagcaccactgcccacgacgcccagtattgctgtacgcagacggtggagacgagtgcgacgatggcgagcagatcgacgccaatgtggccgtgccgaatgctgtcgatcatctcgcggatgctcgtgtagatggtccatgccacgaacaggatgatgatccattcgcccacacccgggtcgaatgcggggtgaatgtggccccacgggcgccactgcggaatgagggccagcggtatggccgccagaatggtgagaggaaggagcgggacttccttgcaaagatcgatgattttcttcatcgcatctccttacgtcggtatcgtcttccgcacctgcacgccgccatagcgcatacagatgtggaaagctagcttcacgccttgttagcccatcgaacacggcacccggcttggtgcgcttacgacacacggcgtaaaaagattgcttgcatattcagttgtattcgcgcgtttgccgcgcatgggttctcactatagcaaaccacacccactggcgtgttccggtataggtgatatgggaagagggtctgcagatcgctctgcagaccctctcgctgaaacggccgattcagatgttcgccgccggtttaccacatgccgaacggatcgatgagcccgtcgttgttgcggttgcgattgttgttgtcgctattgccgtcgttgttgttctggtcgttctgaccgttgttgttctggtcgttctggccgttttggttgttctggttctcgttgcggttgctgccgttcaccgccgcctcggcctggtcgaaggtcacgttgagctccatcgtgtgaccgtctcgcaccacggtgagtttcgcggtggaccccatcgctgcggcacgtacgaatccgagcagcgagtagttgttgttcacggcgaggccgttgaagcccacgatcgtgtcgccggtcttcacaccggccttggctgctgggctgttcgcgacgaccgacttgaccacggcgccgccgcgcgtaacgccatccgcttctaccgtggcgctctggattgtgacgccgagcgccacatgctccaccttgccgttctggatgatctcgtcggcgacccgcttcaccagattcgccgggattgcgaagccgatgccgatggaaccggcggtctgggtgctcgaggcggtggaggcgatcgacgagttgatgccgatcacctgacctgccgcattgaaggtggggccgcccgagttgcccgggttgattgcggcgtcgatctgcacggcgttggtgacgatggcgttgttgttctcttcgtccatcacggtgacgggtcggttcagcgcggagacgatgccggtggtcacggtgccgtcgtagccgagcggattgccgatggccatgatcggctcacctggcgtcaggctgtcggaattcgcgaatgtgatgggcgtcaggtctttcggcggattgtcgagcttgatcacggcgagatcggtcgtggaatcggtgcccaccaccttcgcgctgtagatgtcgccgttgtcgagcgtcacctgaatctgcttggcgccggaaaccacgtggttgttcgtcacgatgtggccctctttgtcgaggatcgcgccggagcccttggcttcgccctggtccacaacggtctggatcgacacgaccgacttcgacacgttcgcggagacgctggcccagttcggcgcctgaccgccttccaccgtggccgagccggaaccgtggttgtttgacgagacgctgctcaacgagctcgacgtggggattttcacccagccgttggtgagcgccgcatagccgacgcccaggcagatcgccgccgcaacgagtgccgcgaccaccgcgacaatgatgttgctcggcgtgcgtgccggttgcccctgctgtgggctgcccggcccgaacggcgactgtgtcgggccgttcggattgcccggacctgccggcgtgccgttgctgggcgcgaacggattgcccgttggcacaccgtacggattgcggttctgcgcattcggtgcaccctgtggcgcgttcggctggttctggtccacgcgcacgccatatggcatgttctgcggattgttctgtgtctggtacggcagtccggactgttgtgcgttcggcgcaccctgctgtgggggcgtcgggatgcgcgtcgtctcctgctgggatgtcggcgcgtacgcaccatattgtggtgccaggcggtacggttccggtttgcgggtcccgtccaccgaagtcgagtcgttcttctcgccttgctcggtggcggaaccggaaaccggcgtcagcacggaggtcggctgttcgtctgcaggtgcggcaggtgccgtgttcaaatcttcggtgttcgcgccaatgttggcgtcggtatggtgctcgtcggagcctgcgttctggtccggcgtgccggtaggccaattattgttgtcgtcagccatcgactctccctatatgtctcctcatgatcgcgctcgggcaatctattcttgtgatagtactcagttaagccacgtcttcttgaagtttcctgaatgtccactgaaaactgaattgttctttcgaaaaagaatctttggaattcacgagaccgcattgtccgctacgcttgcagtgtgcagaccgatttctccgccgtcgtgttcgactatttcgacgtgctcgtggactggcgcccgcatcgcgtggtgggcgcgttctacccgcccggcgtcaccgacatgttcttcgatgaccatgacccgcacggctacgaattctgccgtgcgcgcgccgccgccggtgtgccggatggcaagattctcgacgactacacccgcgagcacggtcccgcggtcggctggattctgcgcctgctgctgcagcatcgcgcgcttggattctacgatatgcccgtcggcatgcccacattgctccgcgaactgcgggccgccggcgtgcgcatggtcggcctggcgaactgctcggagaccgcggtcgagcagatgcaggtgaaatacccgtggctcggcctgctcgacggcacaatggtctccgcgcgcgagtgcattgccaaaccagatcccgcactgttcgagcgtgcgattcgcgccttccatctcgacaccgcgcacacgctgttcgtcgagaacaccgccgccaacgccgccgccgcatgcgaactcggattgcatgccgtgcgtttcgaatccgccgagcagattcgcgcgctgctgctcccggtctcataagtgccgtcagtgccgatcgcccccccaactcggtcgtgcggtgcgctccatcggctcatctgtgtgctgctgtgaaatctggccggtcaggcgaagatgggtgtttctgtctatctgcgattgttaggtgcttccgcaagtagacacccgcctgcaagccgcataaatacgacaaatctacgttttttgtcgcatatttgggtgttttaggggtctgttactggagagggccacctaacaatcgaaaataagagagtgaacagggctgacatggggtgtgattggggggatcctgttcgcgaggacattggatgcgttccgttggccgatttgttcctatctgcgaagaacggccgctgtggcacgtcactcggcggccattccctgacgatatgcgaaaaatggccgatagagcgagacgaacgcgccgaatctgggtcagtgccatgttgcctgactcagtttgctaatcttgtgccatggtatgggacagtgatatggaagatttcgaattcctgcacgaacatgagaagggattcgagccgtctggggagttcatcgagagtcgcagcaaggtgccgattctcgaatacggcatggactattactgtttcgccgacattgtgatcggtccggtattgccggcggtgtacctcaccaatccgctgttcgccacggacaacgagggcaaaccgcactactatgggcgcgaacgcgtgggccggtaccctggaggcacgtggtgggactggggcccggacgaaccgaagagttccaccatgcggatcgaaccggtgcccatatctccggtgaatgtgatgggcgagaccgtggtgccctatgagcggtgggtggagagttacaggaatctaccgggaacgccgttctattccagcctcgacgattccggagattactgtgataaggcttcggtattcgatccgcacggccgtgaggcataccggcgcgcgatgttctatatggaggaggcgatgcgcgtgcatcgcgcttactccgacgaagacgaacgtcagcggttccatgattgtgtcaagctcgccgagattctgtttcggcatgcggctggtcgtggtgacgcccgtgcctgggtcgcgctcgggaaaatctacaaggaggaccttaacaacggcgattatttcaatagctactacacggcgagcatcaaagggcatccgccgatgatcgaacagccgccgatcggcgagcgcgcacgcatctgttttgaacgggcggcggagctcggcgacccagaggcgttggtattcctcggtgacctgcgtattgaaggaatggtgtgcgaacgggacgagagcgccgcattcgagctttaccggcgtgcgtatgcgctggtcgatgagcgtcacgccatgcattacatcaaggccagtgcggcactcagattggctcgctgcctggaatatggcgtaggttgcgagatcgatctcatgcaggcgcgcgatttgtatagattcgcgcatacatacctgcgtgcaatcgcgagaacgtatttctggtggtttgcccgtgaacgccgtgaggcgatggcgcatgaccaggatctcacgcaactgctgtctcacccgtcgcatgtgcaacgtgtggcgctttcgcgaatgggaaccccgcacccctacgagtctgtcacgaagttcctgcccatgctcgagagcatgggtgagttcggcgacgtggtgaatccattctatgtgtcgtacaacggcatagttctgcggttcatggatgaggtaaaccgggtgctcgacaggcagcccgaccttggtttcttcgattacctgggattgctccacgccaagttactggacgcgccgatcgacgtggtggaccccgcggattacgacgcacgtacggtgatggcgatgatcatatacgtggtgcgtcaggagaagttcggcgagggtctcatgcttcattcgctgaatcatggtcttattcagcggtggctgcgccgacttgtccagattgatgacgaacgtgcttcctcatgagggcgacgcatacggtaggcgcatatgcgacgggcggtagcatcggtaggtgtgcgcaatctgttcacgcggacaaccgcacgccttagaattgcgcacatgacagcgaatacagagagcattgtgcaggcaccggccccgcagctggtggagcatccgcgcggcgctgaaccgggcaaacccggcgaccgcagcgccttccgttttgaacagaccacgcgactgcctgattccccgaacggcaagggcaaaggcggcgcccgctatggtcgcaccggcattctgcacacgccacacggcgacatcaagacgccggcattcgtgccggtggccacgcaaggtgcaatgaaggccgtgctgccggaatcgatgacccagctcggcgcacagtgtctgctgtcgaacgcgttccacctgtacgagcgccccggtgaggacgtgcttgacgaggcgggcggtctcgcgaagttcatgaactggaacggcccgactttcaccgactccggtggattccaggtgctttcgctcggcgcgggcttcaagaagacgttggcgatggatgtgaagggcatgaagtccgacgacgtgattgccgaaggcaaggagcgcatggcgttcgtggacgaggacggcgtcacgttcaagtcgccgctcaacggctcgctgcaccgattctccgccgagatttcgatgaacatccagcacaagctcggcgccgacatcatgttcgcattcgacgagctcacgacgctcatgaacacgcgccgctaccaggagaactcggtcgagcgcacctaccgctgggcacagcgttgcgtcgccgagcacgagcggctcacgcagtcacgccttggcaagccgtaccaggcactctatggtgtggtgcagggtgccaactacgaagatctacgccggcatgcggcctcgcagattgcctcgctcgacttcgacggcgtcggcataggcggcgcgatggagaagcggatcatcggcgacatctgcgcgtggatctgcgacgagatgcccgaaagccggccccggcacgtgctcggcatcgccgcggtggacgacatcttcgcctgcgtggagaacggcggcgacaccttcgattgcgtggcgccggcgcgttgcgggcgtaacggcgcgatcttcacgcgcgacggccgttacaacatcaagcgcgcgcagtacaagcacgatttcggtccgctcgaggagggctgccagtgctacacgtgcacgcactacacgcgtgcctatgtggaccacctgctgcgtgcgcacgagatgaacgggttcacgcttgccacgatccacaacgagtacttcttcgtgcatttgctcgacgacatccgcgcctcgatcgacggcggctatttcgacgagttccgcgatgagacgctcgcgcgtttctacgcgaacggctcgcgcgggtgagtgtatatcgcaagcgatatgggaaacggctgatttcgttggaaatcagccgttttcagtggagcggatgacgggagtcgaacccgcctttaaagcttgggaagctttcgttctaccgatgaactacatccgcaatgcgtgcccgcggcgacgcactttcgacagtctaccatagatgcggcataagcgcgcgccgcgtccgcaggggtgtccacaaccatgcaggctcagtgctggcggtactgcgaatactgagcgtagcccgcaacctgcggcgaagcggcaccgggagcgatctgccccatgtcgacggccatctggttcaggcgcgcgatgcggtcctcggtcggcgggtgcgtggagaacaatctggaaacgtcggcaccacggaacggcgactcgatcatcatcgcggcggtggaggtgtcggtgctcgtcttcggcagcggattggcatccacgccaccggagatcttgcgcagggcggaggcgagcgcgagcgggtcgccggtgagctcgctgccgtcttcgtcggcgtcgtattcgcgggtgcgcgagatcgccatctggatgagcgaggcggcaatcggcgcgagcacggtggacagcaggatgccgatgagtccgagcagtccggcgccgttgtcgcggtcgcggttcgagctcgacgaattgccgatgtacatcatcgaatagccgagataggtgagcacggtggccatggcgccggcgatcgccgatgtgcggatgtcgcggttgtacacatgcatgagctcgtgcccgagcacgccgcgaatctcacgttcgtcgagaatgcgcagaatgccctgcgtgcagcagacggcggcgtggttctcgttgcggccggtggcgaaggcgttcggcgtctcggtgggcgcgatgtagatgcgcggcataggcttgcccgcgcgctgcgacagttcgcgcacgatgcggtagagctcgggcgcctgctgctcggtcaccggctgcgcgtgcatcgacgcgattgcgagcttgtcggagaaccagtacgagatgaacgacgtgccgacgccgatggccaggtagatgccgagcgtggatgtgcgcgcaccggtggcccaccagatgatcatgatgatcgcccacatgatcgcgaacaatacagcagttttcaggccgttgtaatggttgtgcaagtgcagtttgccagtcatagagcctagtgtacggcaaatgcgagcggtgggcgggtgaattcgcgaatcaggacagaatattgtggagcgtgccggcgagatcggcgagcagatcgttccggccgcacgcgttgctcatgatggcgatcgcatagcccggttcgttgccgctctctccgcttggcagcacgatgccggcgtcgttgagcgcgtaatagtctccttcgccgttgatccagccggccttgctcagcaccaccgtgccgtccggattctcttcgccgccgtgtgcggcgtcgatcgacgaattgagcgaatgatgcatactcgaggcgagccattcgcgcgccggtgcgctcgccgtctcacccgcgttcggttcgccctcggcatcggcgaacaggtatccgtacgtcttcacccacatcttcgcgagttccaccgcgctcacatccgggtactggaatccgcgcatgcgttccggattctccaccaggccttcgctccacgggatgatcgcactgttcagatgcgcgttccacagcgcatcgtacccgtcgttgtcggaataccgcagcacgcccgcaatatggtccgcgttgatctgcgcggacagcgtgctcccgcttgccgtctcatccagattcactgcgccctcctgcagcagcgacacgatgtacggcgccttgatcgacgacgccgggtaccgcgccacgccgccgttcgccgcgatcacgccgccggacccgaggtcggcgacggcgaacgagacctgcgcaccggcgtcggcgaacgcctgcagattctgctcgatctgctcgcgttgatcactgctgagtgagatggcgacggtgtcgagtgccgagctgccgtccaccgcgctcagattgtcgagcgcggtcgcggtcatctgcgagaccgaaaccgtgggcgtcgcctcatgcagaccggccgccttgatggcgtcgtcggtgagtggcaccggcagctgcggtgcctcgacctcggtgacgggagccggagggatggcttgggtatcgcgcccaaggccgacgatgttgagtcccacgcccaagcagaccacggcaatcactgtgagcaatgcggaaaagattacggtgagcacgcgtttccaatgggcgagcgaacgttcccaattgaggattgcggaggcgatgcgcgcgcgagagccgtctgcttgcgacggcctgtctgcgaacaagcgcatgtctcgcctcacttgtctgcgcgtgactgcgcgttcgaacaggaatgggaatctgcaatccatattcgcacaccgacgtgcaacgcgggcgaatccgtccaatatttcacaatattcgaccggcagctgcagggtgcgcgcggattactctggaggtatgtgcgcacattatctgggattgacggacgcggagctggagcggctcgtcgacgagctcacgatgcaatgccaacgcagtcgggcgcgggtcggggccgacgatgaattcgccggagtcggcgtcgaggcatacccgaagtcggtggtgccgatcatcgtgccgaaattcgacacagccgtgggcgtaccggaactggagccggggagtctggagacggcacgggcgcagtggggattcgagcagcagtggacaccgcagcccgtgttcaatacacgcatcgagagcgcagacaagccgatgtggcgtgcgccgatggaacacgaccgctgtgtgatcgcctgccgctggttctatgaatcgcacggcagcgagatggcggtgagtgcgcgcaccggcaggaagatcaagcagcagtatgtgttccgcgtgcccgacgaaccggtcatgctgatcggcggcgtgcggcgcggttcgcagttctcaatggtcaccacgcaggcgaacgccgacatggagccgattcacccgcgcatgccgctcattgtgcggcaaggtgagctcgatctgtggctcgggccggattaccgcgcgctcgccgatcgttcggacattccgctcgaatcgaagccggtgcgctgagcgggcatgtggccgccacggatatgcccgtgtggttgtcggttgcgaatcttattttgttaagtcagtggatttacgcgcagacacaggtgaggtgcacgtatgacaggcgcgacgaacatggcgacgcgggccgaccgcggcggaaaacaaggcagaaccggcggcaacggcttgggattgttcgcgctcgcagccggcgcgttcgtgctcggcgccgccgaattcgtgatgatgggcatactgccgcaaaccgcgcagaccctgcaggtgagcattccgacggcggggcacttcatctcggcatacgcgatcggcgtgtgcgtgggcacgctgatgctcgtgttcggccgcagaatcccgccgcgcacattgatcgtcatgttcatggtcatcgcctgcgcgggcaacgccttgagtgccatggccgtgaacgcgccgatgctcgtgggtgcccgcttcctcgccggtctgccgcatggcgccttcttcggcacggccacgctggtcgccaagctgctcgcccgcaagggcaaggaggcgcgtgctgtggcatccatggtcaccgggcagaccgtggcgaacatgctcggtgtgccagccggcacgctgctcgccgagcatatgtcgtggcgactggcgtttgtggcgcttgccgtgtgcgccgcggtgaccgccgtgctcgcgcgcgcatggatcccatctgtggcgcctgtgcgtgacgctggtctgcgcgggcaattcagattcctccgccaaccgggcccctggatggtgctcatcgctgttttcgttgggaacacaggtattttctgctggtggagctatgtgagcccatggttgcagaaggtgggcggatggccgaacaacacgatctccgcgctgatgatgctcgccggattcggcatggtcgtgggcggattgatcggcggccgcatcgcagaccgctgggtgcccggcggcacttcggcgcttggccagtgtatcgcctgcgtcggcttgctcgccgtgttcctcgtgcccggctcgcgctggagcacggcgctgttcgcttttgtgatttcgttcgcgctgttcttcgtttcagcgccgcaacagctgctcatggcggaggccggcaagggcggcggcgagctcataggcggggccactgtgcagatcgccttcaacttcggcaatgccgtcggctcgatggtgggcggcggcgtgctggacgcctcgcatatgaactaccattaccccgctctgagcggcgtcccgttcgccgcgctcgccgtgctgctgctcgtgctttactcggtgcggtatgagcggcgcggtcgcgacgagaatccgctgcgtgcctgagcgaggtctgctgttgtgtgtgcacaggtttcgtcatgtgtgcggtaatctgcgggcagattgcgaaaccgagggcatgtgatcacagcttggcggcgagtgcgcgcgcctcgcttgcattgcgggccatgcccatgtaatccataccgtacaggccggcgaagcggttgatggtgtattcgccgcgctcgtacatctgctgcgtgggcgcgccgccccggaacaggaagaagaggcgtttgccggcgaggtcgatctgcgtgaaatcgcggccctcgaggaacgcgtggccaaggtgcgcggtgttaccgccgatctcgccgccattgatgaacagaatgcccatggaatctccttgtgctgtgttacgtggtgtctgtgcgaatactgtatgcgcgcactgccggtagcgactccccgcagtgcggactaccatatgccgaacatgcatgaccatgctgccgattggagtgatgccatatgaccatgcgaaatctacggcgctggggcgcgcggctgttcgcccgcgatccgcagatcatgggctggctgttcgagcagcggtagcgctttgatgtgagtgacgattgccattcaggccaggtcgtcatgcgagccggtgcgtgtcagcaccaattgagtggtgcgaaatacggtgctaagcatccatcaggtctttcatcagactctcggaactggtgaaggacctgccttcgtgtgcttccgtctgccgacgtgcctcaatgctctccggttgttcgcgggtgatcttgaacggcatgccgttgtcgcgaatggattggcgcaggaagacgttgagggcggtggaaaggtccatgcccatcgattcatagagtgccttggcctcttccttgactttcgggtcggtacgaaagctcacggtcgctgtctcgctcatgcgaacccctatggtcttctggctgatgaaatagatatctgccattgtataacttatgtaatgcattgtctatacaatggcagatgtcaatttcgtatcattgcccgagggtgcgcatctccatctgcaatagcgaacgcttcatctccacgccataggcatagccgacgagattgccgttcgcgccgaccacgcggtggcatggcacgatgaacggaatcgggttgcggttgttcgccgagccgaccgcgcgcacggccttcgggtgccccaccgcctcggcgatctgcgcgtaggtgcgcgtctcgccgtacggaatctgcagcaatgcgcgccatacggcctgctggaacggggtgccgctcgcgaacgcaatcggcacggtgaaccgccgtagctcgccggcgaagtactgttcgagctcacggaacgtctcgtcggtgagcccggtcgtctcgcctgcgccgtcggcgtcgtagtccgcctgcggaatgatgcgcagccgaacaacggcatcatcctgccagtccacgcgcaccggtccgtattcactcgcatatgttgcaaatccctgcatctgtgcctcctcctcgatggctgtacgttgccttgattataggaggtcagatttgggttggtgagagggagcgccgaatgctcaccgattctgcgtaatgtcgcgcgtaatgtcgcgtttacgcaaggcgcgcatatattggccatgtgtgtttgtacgcgcacggctgatctgtatggtggcgactgcgcgatggggtgcgtcggggacggaggtatgcgcctggtggggtaggttgggtgtatgggtcgggagcggcagtcgcaagaaacggcacggggtaatggtttccaccgtgtacgcgccatcatcatcgcctgcgtggtggtaatcggtctgttggccggcgtcgcagtgcgtctgtccacatggtggcacgcttacagggtgccatcgatgacggggcagacgattgcgcgcgtgtctgcggacagttcggtgaccgatgacgtgtcgcaatggtacagccagtggaagggcaggcggcaggaaatcggcgttgcgccgcagtatcagttgagctcggtgcggattcgcaccgtgcagcgattgccgaatatcgcgtcgcggtatgaccaatccgatgggcggaacatctacgtgcggctggacgcgacggtgcgcccgcggtttgcgtcgatccagcgcatcaccgacgtgcatggatgccagacatacgccgtggagtcgggaatcaacgaatcgtgtgtgttcacatcggagccgcgtcaggacggttaccgcatcgcgcaggtgatggagccgatcatgtatcagcgattggcgtatccggagcagttcgagaagacggagccggatcccacggctccggtgctcgacggccgcaatgggtatcgtctgtccaaagagaggctggaggtgacctacgacggcgggacgacgtggcgcgaggtgcccgacggcgtcgcgcgcatcgtaggcggcatcaacgcgaacaccacgctatggctcgagccgtcgaggtatgtgatcacgccacagttcacggcgttcgtggggtacgacgagggcacgcatacggcgcaactcctctattcatgggacgccggttcgacgtggctcacgtcggcattggggcacggtgtgcaggctccctcctacatctccgtggttggcgaccgcatcggggtggcatatgggtatggcgacacgcttggctcggtcgggtatgcgatggtcgcgggcacgttgcccgaactgcgcgcggatgcggaggctgtgtggcggcagattccgatgtatatgcaatatccgtccgatctgacgatggcgggatgggtcaatgacaccacggtgatcgtcgggcaggccggatcgctgcatgtctcgtcggattcaggggccacatggcgtgaactgggaatacccaaggaacctggtttggagggcaagctggggtattacccgtttgatacgccgacgcatgtatgggtggaggatggcacggcctatctcgcaatgggtcagggagaagatgccgattatgcgccgaatggcacagtcgtggaggcggtgttctcgtacgatcccgccacggatgcgtgcaccttcatcaggcaacagcccgcccccacgccaatgcctgcaggttgaacgccgctccttgcttcgctttgtcggcctccgcgacgatgcgcagggcgttcagcgtgcgcgggtagccgatgtagggcaggttctgcagtaccactgtgcgcaggaagtcggcggtgttgccgagggcgatgttcgccttcgtgtgggcgagcagctgcggttccacgctaccctgtgccgcgagatagcagaacgtgatcatctcgcgctgcagattggtgagcccggtgcgcgtgtagtagtcgccgaagcagttgtctgcaagccaatagttcaccttgctgcgctcgtagctcttgtccatgccctcgccgaacagctcgacctgcttggcattgccggcctcgaggcggttctccatggtcgtggtggtctggtcgggcaacggcagggccactccgcgcgcttcgagcacttcgttcgtgatggcgaggaatggccgcacgcgaccgatgccgaggtagtcgacggcctggtgcacgacctccttcgcctgcaccggcgtcaacccggcgtcgagcgcgcgcccgagctgaatgcggaactcatccgcgccctggcagccgagcagcgtggccaggatggccagatagcgcgtggtcggttcaagctccgtttcggggtctcgcgcgacctccacgtcggcgaaatgcagcatgcgctcggcgaactgcgggtctgtctctttcagtcgttcattcggttgttcggttatgccagccattccagactcctttgcgtattgtttcacttgagcgagcggtagaatgcctcgtccaccggttcgagccaatcgttgctcttgccctcgcccggcacgtcgatggcgatgtgcgagaaccagctgccgggggccgcgccgtgccaatgcttcgtgttcgccggaatgtgcacgacggtgcccggcgtcatcgcgatcggttcctggccttcgatctgcgcatacccgcggccgcccacgcagatgagcatctggccaccgcccttcgtggcgtgatggatgtgccaatggttgatgcagccgggttcgaaggtcacgttggccatgctgacctgttcgccggagaccggcgcgagccagcttctgccggtgaaatactgcgcgtaggcgtcgttcggctcgcccaccgggaacatgagcgactgtgcgtatgcggtcggaacgccgacgggaatcgggtaattgttcattgcttgcctcttttcatatgccttttcatatgccgcgctcggcatgtctgtgagtgttatgcggcgcactgttgcatgcaacaaatgatgaaaaatcatgtattgcattcgcgatgtgcatatggtctgcgcggtctgcgcttacagattccgcgtgaagaacccggcgatcgtgtcgaacgggatcgcattgagattgtcatacaggtcggtgtgattggcccccgggatgatcagcagttccttgttcgccggattcacgccatgctcgagcttctcatacgcggccttgctgaagtacagcgaatgcgccttctcgccgtggatgagcagcgccgggttctcgatttcgccgatgtaggtcatcagcggcatattcatgaacggcagcgacgaggtgacgttccagccggcattcgagttcaccgagcgcgcatggtagccgcgcggggtcttgtagtacgcgtggtagtccctgacgaactgcggggcgtcgtcgggcagcgggtcgatgacgccgccggcgcgcgcatagtcgccgttcgcgtagtcctcggtgcgctgcttggccagctgtgtgcgcatctcattgcgtttggcggccgagtcgtcggcgtcgaagtagccgttcgcggtgacgcggctcatgtcgtacatggtgctcgccacggtggccttgatgcgcgggtcgttcgcggccgcgttgagtgccaggccgccgaagccgcagatacccacaatgccgatgccctccggatccacgtcggtgcggttcgccagatagtccacggcggcggagaaatcctcggtgttgatgtcgggggaggcgaccgcgcggggcgagccgccggattcgccggtgaacgacgggtcgaacgcgatcgtgaggaacccgcgctcggccaaggtctgcgcatacaggccgcttgcctgctccttcactgcgccgaagggtcccgagacggcgatcgccttgaatctgccgttcgccggcacgcgcttcggcttgtatacgtcggccgccagctcgatgccgtaacggttgtggaaggtgatcttgccgtgctccaccttgtcgctctgagggaaggtcttgtcccataccggggtcagttcaagtgccgtcattgcattcactccttgttggtatgcagttggtgtttggttgatgatgtcagtatgaacgcaatggcgatataacgcaaatagttatttggtataatcattattctgtatgggaataatattgggaaaggaagccgatggagattcgcgagctgcgtgcattcctcgaagttgcgcgcgaggagaacatgacgcgcgccgcgggcaatctgcatatgtcgcaaccgtcgctgtcgaagctcatcaaatcgctcgaacacgaactcggggcgaaactgttcgtgcggcgcagcttcggcctcacgctcaccaaggaggggcgcgtgctgcgcgagcgtgcgcgcgatctggtgggcatggcgaaccgcatcgaagacgaattcgcctcgcttggcaacatcaccggcggcacgctgtatttcgggctcgcggagtcataccagattcaatatctcgcccggcagatcaagattctgcgcgaacaggccccggatttgcggtatcacgtggaaagcggcgtctctgcgcaggtgcttgagcatctcgatcagggctcgctcgatttcgccgtgctcgcgcaggaccccgatctgacgaagtatgaggcgctgaccttcccgggcgtggatcggtggggcatcattgtgcccgcagaccatcggctggcatcgcggtcttacgtcgaactcgacgacttggtgggcgagccgctgttctgctcgcaacagggatggaagcatgagatcgcgcgctgggctggctcgcgcatgcccgatctgcggcttgaggcgaccttcggactcgcttacaatgcggccgtcttcgcgcgtgaagggctcggtgtgctgctcactttcgataggatcgtcgacaccagcgcggattccggcatcgtgttccgcccgctcaaaccggccctcgagaccaaattgcacctcgtctggcggcgtaaccggccgctcagcccgatagccgagcggttcctggaccagctgcgccgcgcctagcctgcgcggcgcagctggtgggcggttcggccgttcgtcgctacttgcgctcccagcttttggcgacggctgcgttctccttcgtgttctgtgccatgacaccgacgattggatgcggctggtatggacgttcgagtgcggcgatttcgctgtcgctgagctcgaaatcgacggccgcgacagcgccgtcgagatgatgtggtttcgtcgcgccgatgatgggcgccgtcactttggtgagcaaccatgcgagtgagaccgtcgtcatcgtcacgccacgggcttcggcgatgcgtctcacctcgtctatgatgtcggcatccattgcggcggcggcatcgtacttaccgtgggcgaaggaatcctcgcgcagtctgcggctcgtctcgcccggcctgcggctcaggcgcccgcttgcgagggagctgtatggggtgagcgctatgccctcctcctgcgcgcagggcagcatctcgcgttcgtcttcacggaacagcagattcatgtggttctgtacggagatgaactgcggccagccatgttcgcgggcgatggcgttggccttctccagctgccacgccgcgatgttcgccgcgccgatgtaccgcgtcttgccggcggccacggcgttcgcgaagccctccatgatctcctcgatcggcgtgcgccaatcccacatgtggtagatgtacaggtccacgtggtccataccgagatggcgcagactcatatcgagattgtcgcggacgtgctgctggccgctcacgccgttctcgatctcctcgtcggtgcgcggcaggaacttcgtggccaccaccacatcgtcgcgtgccgccatggaggagagcgcgcggccgaggtattcctcggacgtgccgttctggtagacgattgccgtgtctaagaagttgatgcccgcgtctagcgcctgctgcacaatcgcgcgtgatgactcctcgtcgagcgtccagctgtgttgaccgttgcctgcatcgccgaagctcatgcatcccaggcagatgcgtgagacttcgaggtcgctcgggccgagtgtggtgtattgcataggttcctcttttccagtgtcgtatgcgttattcgtagatgtgggttgggttcagattaccgggcgaacacggtggtgagccatggggcgaaatactggtcgatccagccgccgtcggcgccgaaaccgtgcggccagccgttcatctcatgggtttcgacgctcacgcctgcgtcacgcaacgccgcaatcgcagcgatggcgagtcgtgtgaacaaatggccgtggcgtattcgcatggcttcctccgatactcaatactcgtccaataagtgaattggttatgcagggtctaccgggtgaacggctcgtagaacatgcgcgaaccgggcacaccgtgacgtagcagcatgcggcgcacgtcgcggatcatgccggaggggccggcgatcaggtagatcgcgccatcggtgatctgttcggcgagttccgtcttgctccagcgccccacctgcatgtgcggcgtgtgcgcctcgcttgcgctccacttacgcaattcgtctgcatacaacaggtcgtcggcgcgtttcgccgtgtacatcacggtgaccgggcgattggtgccggacagcgccatgatcgtgggtatgatcggcgtgatgccgacgccgcccgcgtatacgacgatcggtgcatgcgcatcgtggcgtgcgatgaaccgttcatacatgccgaacggcccgatgacgtccacacgcatgccggcccgcgcggtgcggtacagccgctcggtgaagtcgccgttgatgcgcacggcgaaccgcatcgcatcaccatgctcgccgggcagattcgcaatcgagaacgggtgggacccgtgcatgccgcgttcgcgggggagtctgaggaacacgaagtcgccgtattcccagctgtgcatcgccgggcagtccacgagaatctccacgatgtcgtttgagaccctgcgcgcggagacgaccttgccgcgggcggcgaacatgcggtcgcgcaatttcacccacgcataccaggcgagcacgagcccggtggtcacgtccatcgtgacgatgaacgccgtgaggtccttgatatagaagaccagattgaaatgcaggcaggcaagcacgacggcgacgagcacaatgcggtgcagccacacggtgaactcatggcggaacacgcgttcgagccagctgcgcacggtggcgagcggcggaaccagcgtatcgagccagcctgccatcatgacgagtgcgagcgcgacaatgccgaccaacgtccagaacgcgatctcgcccgttgttttcgccggtccgaacgacggcagcacgtattggtggtagacaacgagcgcgagcgccccggtgccgagcacgccgtgcagcacgtagatgccgggcagtcctatgatgcggtcgagccagcggggtcggcagccgagccacacgcattcaagcatccatatgtaggcgtagatgccggcggtgatgggcgtgagcatcgaacggtacatgggtccgagcgtggcccatgggatcgccgtgaacggcatgggcaccacgacgagcgcggcggcccacaccaatacagcctgaatggggaatcgacggattgcaatgcgtttcatgggcatatgcgtcggttagcgtaaggaaacggcaggctacttgagcacgccgatcttctgcagccagggctgaatctcgtcgttcgacgtgacgcgcaggccctcggtgacgttggcgcccttggcgctcgaccgaagcatgtcgagcgtgccgtcgatgccgctgcttgcggacgtggcgaaggggatcaccgtcttgccgttgaggtcataggattccaggaacgtgagcacgggcatcggcggttccatccaccagatcgggtagcccacgaagatcgtgtcgtactgggccatgtcatcgaccttgcctttgacctgcgtgcgcgcgttctggttgagctcgtcacgggcgatctcggtggtgcgctggtattcctccgggtaggcctgcacgggttcgatgcggaacatgtcggctccggtgagcttctgtatttcctcggcggcgcgctgcgtggtgcctgtcttcgagaagtaggcgatgagcgccttgccgttgctgcccttcgtcacggtcggggtgtcgccggaggtgccggtgttgttcccggaatcgttcgacgccgtggaggatcccgacgagttcgatgaggagcccgaggtcgagccgcatgcggagaagccgaggaccattgccaaggcaagcagcagtgcgagtaggccgcgtgagcgggttgacgtggtgttcatggtgttcctttccggttgttctcgtggattggatgcgctgtggaattggtcacggctcgatgtgcttggcccagaacgccgtggcgtcatcgatccagccttcggcggtggttcccacgccgagcccgaagccgtggccgagttgtggatagtggtggaattcggtgtcgatgccggcggcttcggtgccaacaaatctagcgggcgggagcgctaccggcgcgaattggttttctctcggctatgtgccggtagcggtaccggtcagcatcgggcatactgtctgatgatcgtgaatgctgtcgcgtacggcacacgacgcgatcggatgggagcgaccatgtacacgatgaagcaggcctgtgagctcaccggattgagctacgagaccctgaagttctattgccggtcggagctcgtgccgcgtgtgcatcgtgacgcacgcaaccacagggtcttcgacgaccacaacatcgcatggatacggtcgttggtgtgtctgcgccgctgcggcctcggcatcgccgagatgaagcggtgcgtggccctatgcctcgagggtgaggcgtccattccgcagcggcgggagatattggcggagaaacgtgaggagctccagcatcggttgcaggacatcgaggattcgattgcctacatcgatgccaaggagcagttctacgaggcggtgctcgacggcaccacgccgtacgtgagcaacgtgctcgggttggaggagtgagtgctggggcagtggatgggcgcggcatgcacgcccatccaccaccgtgccgtcaggcgatcgaatccgcccaggtcttgagttcggcctcgctggcattcgcggcgaagcgacgcccgttcacccaatgggcgtccggtgccgaatcgtgcagttgctcgccgagtgcgccgcgtgtgcttgacgacgacgtggcgaacgtggtgatcgtcttgccggtgaaatcatgcgattcgagccaggtgcgcacttcgcgcggtgcggtgtcccaccacagcgggtagccgacgaagatctcgtcgtagccgtctgcggaggggcttgcggagatgggtggccgcattgcgcggtcggcgtgctggcgcgaagcacggctcgtcggatcggtccagtcgatgtcctgcgcggtgaacggcggcaccgggacgatctcggcgagatcggcgtcaatcgccttcgcgaggttctgtgccacccgccgcgtggtgccggtggcggagatgtatacgaccaattgcttgctcatggcgttgccttcctgtttgtttcaatgaggtgaggtgtgctgtggaacgtgcttggatcgcggccgctcactgttcggcgcgcatcgtctcgatgcgtgcgatctgctcgcgtacgcgcttgggctgggtgcactcggggaagttgtcgcggtccagcacgccgtcgagtccggtgtcgggttgcagtgcggcgaacatcgacgcgagttcggcgtcggtttgcgccgtgccggccacgtcgatgagttcgagcgtcttatggtccgcttccttgcagccgagtgcgtcgacgagcgtctgggcgacctggcggcgcgccgccgagccgtcctgcggccccatggggtcgcgccggtctccctgctcgaacttcagctggtgctcgtcggcgccctccatgtcgaaccagcccggccgcacgatcgtgtactcgttgcccgaggcgcgcaccaggcgttcgctgtggcgcttccaatcatgggcctcggtggagcggttgtagtcgttgtccatgttcgtcacgccgatcgacgtcatcagcgcaatgcgcgcaggacgcccgtcgagtgcctccaacgcgttgcgcacggcaccgtaatcgacggtttcggtgagcgtgggccctccgttcgacccgtgggtgaacacaatgccgtcaatgccgtcaagggcctgccgcattgactccacgctcgtcaggtcgccttggaccacttcgaccccgcagccgaaatggatgcgtgacgggtcgcgcacgagtgcgcgcacacggtagccggccgcacgcgccttctccacggcatggcgccctatgcttcccgaggcgcccacgaccagtacatgtgttggtttcatggggctccgacctttcgttacgcttcggcgatgtcgatcatcgacttgatggcacggcgtccgtccatcgcctcataggcctgctgcacatggtcgaggtcgaaggaggcggtgaacaccttgcccgggttgatttcgccgtcgagcacggccttgagcagtgtgctcttgtcgtgcgtggccaccgaggcgatgccgccggtcagcgatacattgcgccagaacagcgcgttcacgtcgatgctgttgtcatgtggcacgccgacgcggctcacataggcacccgggcgtccgctgcgcacggcggattcaatgctctgctcggaaccgacgcattcgagcacgcggtcggcgcccgcgccgttcgtcatctccatgatgcgggccaccgcctcgtcgccgcgctcgggaacgatgtcggtcgcgccgaattcacgggcaagtgccgcacgatcctcatgacggctcatcatgatgatcctgccagcgccaagcagcttcgcaccgatcaccgcgcacaggcccacggcgccgtccccgtagatcaccacggtgtcgccgggttcgatcctcgagctccacgcggcgtgatagccggtcgccatgacgtccgagagcgccagcagcgaggcgatctgctcgtcggtgtagtcggcgggcgtacccggaatcttgatgagcgcggtgcctgcccaggtggcgcgcatgtattcggcctggtagccggcattgccgccgggctccatgttgaagcagttgccgtcgtatcccttctcgcaggcctcgcagtgcccgcagcagtgggtgaagggaacgatcacgaagtcgccgggcttcatgtcgtgcacgtcggcgcccacctcgtcgatgatgccgatcgcctcgtggcccacgagcgtgttgtgcgggcgctccgagatgccgcggaaccaccacagatccgagccgcatacgcatgccttgagcacgcgcacaatcgcgtcggtgggcttctcgattctcgggcgctccacttcgcgcactccgacgtgttcgggttccacgaacaccgcggctttcatcatgttctccgccatagttgtcctttcgcgttccattcgctccggtccgcacatcggcgtgattgggagtgcacgtgattgggagtgcatgggtatgctgttgcgtatgtgaacacggtaaatccgcgaaaaagatattacaaatacaaagatttgatataattgtatgcaaatgttcgatgtaaatctgtgaggtgatattcatatggatattcgcaccttgcggcacttcgtcgccgtcgtgcaggaagaggggatttccgcggcggccgacgtgctgcgcatgagtcagccggcgctgtcgcggcagatgaaggagcttgagaacgagctcggcgtgacgctgttcgagcgaggcaaccgcgggcgcagcatctcgctgacgaaagaagggcgcgtgttctaccggcgtgcacggcagatcatcgaactcgccgaccgtgcgcgcgccgaagtgcatatgcacgacgagatcgccggcaccatacacatcacggcggcggaaagcaatctgatgaacatcgtggcgctcgccatcgcgcagacgcgcctgctgtacccgcgcatcaccttcgacatccacgacgacaacggtccgaacaatgtggaacgcctcaacaacggcatcgccgacttcgccgtgatcatgcagccgatcgacatgacgcgcttcgaccacctctcattgcccggagccaatccgctcggcatcggcatgcgcgccgacgacccgatcgccgccaacgagacgatcacgaacgagctgatccgcgatatgccgctcatcacgtcgacgggcgcgaaccagcgccgcgatctgtccggatggctcacgcaaggcacgacgctcaacatcgtctcccacgtgaatctcgcatacaacgcggcctgcctggtgcgcaacggcgtcggctacatgctcaccgtgaacgatctcaccgagttcagcgaccccgaacacgatctcgtctggcgcccgctcgacccgccgctcgacattcgcctgagcgtcatctggcgcaaggaccgcgacctgtctcgcgtctgccaactgttcctgcagcagttgcgcacggtgatcacgcagatccggaccgcgcagtagcgctaccggctcggctcggcggcctcgggcagcccggccatcttgcacagctcatcgatggtgacgaacgagtagcctttcttcttgagctgcttgatgatctccggcagcgccttgacggtctggctgcggtcgccgccgcccgaatgcatgagcaccacggcgccgttgtgcacgtaatcgaccacttccttcgtgatctgcttctctcccggccgcttccagtccaacgtgtccacatcccacagcacattcctgtcgatcagcgtggcgttgttcttccactcatccacgccgaacgcgccgtacggtgcgcggaacgtgcgagtgctcacatcggacgccttcttgatgtcgctgaggctgctctcaatctcctgacgctgctcctgcgcgctcatgttcgggaagtacgggtgcgagacgctgtgcgaggcgatctggtggccctccctcacgatgcgctgctccaccttcgggaattcgagcgactgctcgccgagctcgaagaacgtcgccttcaccttgttctgcttgagaatgtcgaggatcttgtcggagtagatgctcggaccgtcgtcgaacgtgagcgcgatgaccttcttgccctccgggcgcggtgcgaacgacttcacaatgagcggctcctgcttgcgaatcacggtcttggcggcagtcttcttcgactgcctgcccacccagaactcctgcaacccgtcctcgccctgctgggtgacgatctgcaccggtccgccgttcagattgatgtccgtcttgaacggcaccttccgctgctccaccgtatgctcctcggtgaggtcggtgcccggcgtgaccgtaagcgtgccgtttttttcgaaacgtgtgtggtcccagtcggcgggctcgatctgtttgccgtcgaatttcacgctcaccgtgttgccgccgctaggttcgagcaccttgccctccaccgacagcaggcgacccggtttgcgttcgaaatcgcggtggtcgcgcatgaacgccgccaccgtggtgtcggccttcgcggagtacgcagtgccgtccacctcaatgctgagcgtgcgccagtggtattgccacatgtaccaggccccggcgccgagtgcgagcacaagcagcacgatgagcgtggtcacggccgagaacagtgccggatggcggtgcttaggcttcggggcatgcacgttgtcgccgaacgagagatcctcgacctcgtgttcgaactccgcgcggcccgcctcctcgttctcataatcaggaatgcgctcggcgtctttgcccgccacgtgatcctcgcgatccatcttcaatcttctcgccactgccaacctcgctttgcaacctcttccagagtactattcgcccactggttttggccagcggcctcggcatctgagctcaccgtgaagtgcctgtcgcgtaacgtgcacgcgcgcataatggaactatgagtatcgcaacaccggaacagtatgcacacatgctcgacgccgcccgcgcaggcggctacgcgtaccccgcgatcaacgtgaccagttcgcagaccctcaacgccgccctgcagggtctcgccgacgccgaatccgacggcatcattcaggtgtccgtcggtggcgccgcatatttctcgggccagcgcgtgaacaaccgtgtcaccggctcgctcgccttcgccgcgttcgcacacgaggtggccaagcagtacccgaacatcacggtagcgctgcacaccgaccactgtgccaagcagtatctcgacgaatgggtgaatccgctgctcgacatcgagatcgacgaggtgaagcacggccgcgagccgatgttccagtcgcatatgtgggacggttccacggtgccgctcaaggagaatctggacatcgccgagaagctgctcgagaagtccagactcgcccacaccgtgctcgagatcgagatcggcgcggtgggcggcgaggaggacggccactccgccgagatcaacgagaagctgtattcgagcgttgccgacggcatggccgtggctgacagactcggtttgggtgagcgcggcaaatacatggccgccttcacgttcggcaatgtgcacggcgcgtacaagcccggcgtggtgaaactgcgccccgaactgctccacgagattcagcagggcgtgtggaatgcggcgaagtcgggcgaactcaatgccgtgctcaattccgacatgcccgacggcaagccgttcgaactcgtgttccacggcggctccggctccactgcccaggagatcgccgaggccgtctcgtacggcgtgatcaagatgaacatagacaccgacacccagtatgcgttcacccgcgcggtggccggtcacatgttccgtgattacgacggcgtgctcaagatcgacggcgaggtgggcaacaaaaagcagtacgatccgcgctcgtggggccgtgaagccgaggattccatggcggcgcgcgtggtggaggcctgcgaggagctcggttcggccggccgcgcactcaagtagtgttcgcaggggcggcgcgtgcgtgcggtaccgccactcgcggtggttgttcttgcagttgcttcctcgctccggctgttttccgttcctttcgcgtgctgtttttgcaatttcgttctcatcgcgtatggtttccgctccattcgtgtgccgttcttgcaactgcattctccgcggggtgatcgtagacggcttcccttgtcgttcttgcagtcacgttgaggggccggccatcctgtggcttttaggagtgcttcttttgcatccgcgctctcatggttgccggattgcatcttccctcttgtcgttcttgcagttgcttcctcacccgggtcagattcctgcttcctcggtagttgtttttgcaattgcttttgcgattgcggctattgtgcgacgcctacgcgcatgtcgcaggcgtcgccatgcatgccgccctgcgggaatcgggggatgcggcagtctcatctcacgaggcgacccggaaaccgccgcttcaagagctcgtgctaacctgacttcggctacattagacccaaagcggaggttggaatgcctggaatcgtgttgatcggtgcacagtggggtgacgaaggcaagggcaaggctaccgatttgatcggcaccaaggtcgattacgtcgcgcgtttcaacggcggcaacaacgcaggccacacggtggtggtcggcgacgagtcgtatgcgctgcatttgctgccatccggcatcatcagcccgacggcgactccggtcataggcaacggcgtcgtggtcgacccggaggtgctgctcgaggagatcgaggggctcgagagccgcggcatcgactgctcgcgcctgctggtgagcgagtccgcgcatgtgatcgcgccctaccaccgcatgatcgacaaggtgaccgaacgcttcgccggcaagaagaagatcggcaccaccggccgtggcatcggtccggcctatgccgacaagatcaaccgcgtgggcatccgcatcgccgacctgttccatgaagacgtgttgcgcgacaaggtgagcaatgcgttgcaccagaagaaccagatgctcgtcaagctctacaaccgccgcgccttcgacgtggaggccaccgtgcaggagctgctcgaggtgggcgtcaagctcaagccgtacgtggcgaacacgtcgctcattctcaacaatgcgctcgacgacggcaagaccgtgctgttcgagggaggtcaggccacgatgctcgacatcgaccacggcacctacccgttcgtcacctcgtcgaacccgaccgcaggcggcgcctgcaccggcaccggcgtcggacccacgaagatcgaccgtgtgatcggcgtctccaaggcctacgtcacccgagtgggcgaagggccgttccccaccgagctgttcgacgaaaacggtgaatggctgcgtgcgcagggccacgaatacggtgtgaccaccggtcgcccgcgtcgctgcggctggttcgacgccgtggtgaaccgctatgccacgcaggtcaatggtctcaccgacatcgtgctcaccaagctcgacgtgctcaccggactcgatgagattccggtctgcgtcgcctatgacgtgaacggggtgcgctacgacgacatgcccaccgaccagtcggccttcgccgccgccaagccgatctatgggatgatgccgggctggagcgaggacatctcgcaggtgcacgctttcgaagatctcccgcagacctgccaggactatgtcaagcgccttgaggagctctccggctgccgtatctccgcgatcggcaccggcccgcagcgcgaccacatcatcgaggtccattcgcttctcgactgactttcggctacactgtttccgtgcccttcgcgggcatgcgggtccgcgcgcgtcgcagtgacgcctgccgtactcccgcaatctgaacacctgtttggcacggtgcagtggccggcaatagagacgaggcgatacgcgcaatgaccacgcgaccagaacacttgacgcatgccgatgcgacgtcaccgggcgacgtcgatgcttcctctgctgccgcggaaccgggcgattccgacgcccaccttcacctctacgattcccagtcgttctcgccggccaccggcgccccgcacgagccggtgacgccggacttccgcaaggagatgctgcagccgcaccccaccggcgccgcggccgcacgccggcctccgagcattccgctgtcgccccgcaaacgcatgcaggccaagttcaacccgctcgcggacggcatgatgtatctggtgatcttcattggcggcatgctcggcacggtcctgcgctattcgctgtggctgctgtggccgcagccactgtcgaagggcggtctgctcatggcattccacccggccacgctgatcgcgaacctgtgcgcgtgcttcatattcgccgtgctcgtcagttacatgtcgcaggccgtgtgggtgaagaagcgcacgcgccagcttgccaacggcggcttcggcatgggcatgtgcggcgggttctcaacgctttcggcgatgatggtggaagacatcacctcgctccactcccactcgtacctgggattcttcctgtacacgctgttcacgttcgtcgcggcgttcgcgatcgcttggttcggcagctggctgggcctgcgtcttgcccgcaaacgcaccggcatgcatgtgcgcgaacgcatggagaccgtgagaaagccggccattggcgtgcgcgtgcccactgcgaacggcgtgcagatgacgccctccgccggcgacgacccgaacccgagcaccgacgagctgccgatcatcagcgaagaggagcacctcgacttgctggcagacccgcacatggtggagccgttgcagcgcacggccggcaaacgcgacggaggtgcgcgctgatgggaaccttcctgctcgtctgcatatgcgggggactcggcgccgtcgcccgtttcatgctcaacacgtcgattcaacgctggtggcatagggcctacccgctctccacgttcatcatcaacatcatcgccgccctctgcgctggcactgcggccgcggcatacttctaccaaacagtgaactattccacttatttgctgtttgtcgccggttttctgggtggtttctccacgttctccacggcgatcaacgagatggtgtcgctcactcgcacgcgtcagctcgcggtggccgctttctacttcctcaccacgctcgtcgtgccgttctgcgccgtggtgctggggtggttcttcggctcgatcgggcattgatacatgaatactgttccgtgcctgatcgcggaacgtcaggatcgtgaggtcttgtctgaggaatgccttcgctccgccatctactttttatctcatctcagattcacccgtgaaacgaaccaagtgcctcatacttggtctgtttcactgagcgcaatctggcgagacagattaagtgcgcggtacttggtttgtctcacgcgcagatcggattccgcggcatatgggaagcggcataggggaaagggctccgttggcggagttcctgaactggctgctcgaggtcgcgccacagcgcaagtgcgcgagaagagcccgcgcggtttccgcaaacgcatgggctggcactggcagctcgcctcgcgtatcgaacccggcgaggtgcatggtgcttagcgccagactgcagtcattgtgcgggacccaactgccatgtgcatgattccgttcgcacgcgcgtaaaataccacagattgtaagcgacatgtgaacggccgcgttgcagagtaacagaacagaaaaccgagtgaaatttgcgctcgccattctccccctagattggaggcaacgaagagagagggggtgcatatggcatccatggtttcacaaccacaacgccgtgccgaacgcgggcggcgccgaaagggtctggccatcgtgtgtgcgggcatcgcgggcttgttgctggcgatgctcgccagcatgatcggcgtgccgaacgccgtggccgcggaggcggtggacaagtgcgtgccgaacgcggagcacggctgtgtgagcggcattctgcagacccaagacaagacgccgatccccgacgtgacggtcacgttgggcggcgaggaggaggccacggccaccactgcggaggacggtgcctgggccttcgaagtgaatgcggacggcgagtacaccgtgagcatcgacaaggcggtcgccgagaagtacaagctcggcgaaagcggcgcgacggtggagatcgccaagaagtcgttctccaagcagcgtgccgtcgtgcgcttcgacaaagccgcggcaggcagtgcggcggaaacggaaagcggcaatgccgactccgccaaaagcggggagcagactgcggcgaataccgcgcaggccggcgatgacggcaagggctccggcttctggtcgcgcttctggcagcagctctactcgggttgcatcttcggcctcatgctcggcctgatggcggtgggcatgaacctcgtgtacggcaccaccggcctgagctccttctcccatggcgagcaggtgacgctcggcggtctcatggcctatgtgggcacgcagatgctgcatatgccggtcgtgctctcggccatcttcgcggtggcgatcggcgcgctcgccggatgggtgcagaaccagctcgtctgggcaccgctgcggcacaagcgcgtgggcgtcatgcagcagatgatcgtgacgatcggcctgtcgatggcgttgcagtacatctaccagttcttcttcggcggtgacatcaagggcattgtcaagtcggtgccggagggcattcagctcggcccgatcgtcacgaacgccccgacgctcatcgcggcggccattgcactggtgaccatagtctccgtcaccgtgttcctctactgcacgagactgggccgcgccacccgagccgtgtccgacaacgcggcgcttgcggcggcctcgggcatcaacgtggattcggtggtgcgcatcgtgtggatcctctcctgcggcctggccgcgctctccggcgtgctcattggcatccacctcaacggcatcgcctggaacaccggcgtcacgttgcttatgctcatgttcgccgccgtcacgctcggtggcctcggcaccgcgaacggcgctctggtgggcgccctgatcgtgggcattgtggccgatatgagcacgctcgtcattcccagcgacatgcgctacgccagcgcgctggcaattctgattctcgttctgctgattcgcccgcagggcattttcggcaagcaaaagagggtgggctgacctatggatttcatgaccatactttccaacatcctgggcgagctcttcgccccgaccacggccgcatatgcgctcgccgccatcggcctgaacatccactttggcatgtcgggcctcatgaacatgggtcaggccggcttcatgctgctgggcgcctacggcttcgccatcacgcagatgaacggttgcgacctgttcacctcggtgctcacggcattggtgcttgccgcgatctacggcattctgctcggcatcccgacgctcaagcttgggccggattacctcgccatggtcacgctggcggcggcagagatcattcgcatcgtgggccgctccacgtcgctcacctggctcaccggcggttctgccggcatcgcgccgcagaacttcaccgagaagttcgaaaacgcctcgccgctgccgaacggctccaccaagttcctgctgtggacctacaacaacaacatcgcgaactcctggtggctgcgcatcgtggcctgggtgctggtggcgattgcgctgctgctgtgctggcgctggttccactcgccgtggggccgtgtgctcaagggcattcgtgaagatgagaacgcgatccgctcgttgggcaagtcggtgaccaagtacaagatgcaggccctgatcctgggcggcctgttcggcgcgatcgccggcatcgtgttcattctgccccgttcgctcaacccggattcgctcggccgcacggtcacgttctacacctggacgatcctgctgctcggcggcgctgcgacgatcatgggccctgtgctcggctcctgcgtgctgtgggtgctgctcaccgccgtgaaggagacgatgcgtgtgacgattccgaccaccgtggtctcctcgaaccagatcgaggccctcggctgggtgatcgtgggcgtggcgctcatgctgctcgtgatcttccgcccgcaaggcattctcggcaacaagaaggagctggcgttcaatggctgacacaaccgacaagacaagcgagaccacggccgccggctcgacggccaccgtgaaggaaccgttctacgacatcgcgaaatgggctacgaaggcgccggagggggagaagctcatctccaccgcctacggcgacaaggtgaccgaagacctgcgctacgtgaagaacgagcccggcgtgcacaagcccgacccgattctggtggctgacaacgtcacccgtcgcttcggtggcatgacggccgtggatgtgcggcatttcgagatcgaacgtcatggcatcacggccctcatcggcccgaacggcgccggcaagacgacgttcttcaacctcatgaccggcttcgacaccccgaacaccggcacctggcagttcgacggcaaggacatggcccatgtgaacccggagaaagtggcccgcggcggcatggtgcgcaccttccagctcaccaaggtgatgagccggctcaccgtactcgacaacatgatgctgggcgcgcagagccaccccggcgagggcatgttccggtcgctgttcccgggggcgtggaagaagcaggagaaggagaaccgcgagaaggccgaggccctgctcgaccgcttcctgctctacaagaagaaggacgactacgccggggcgctctccggcggccagcgcaagctcctcgaaatggcccgtgcgctcatgtgcgacccgaagctcgtcatgctcgacgagccgatggccggcgtgaacccggcgttgaagcagagcctgctcgatcacatcatctcgctgcgcgaagacggcaccacggtgctgttcgtggaacacgacatcaacatggtgcgccatatcgccgactgggtcaccgtgatggccgaaggcaagatcgtggccgaaggccagcccaagacggtgatggacgacccggccgtggtcgacgcctacttgggcgcccacgccaacatcgacctcggcgacgactccgtactcgaaggattggagggtggcaatgcctgacaccgcaacactgaccccaaccgaggcccccgacgtctcgacgctcgaccgctcgcatatccatgcgggcgagccgctgctcgacgccgacaatctggtcgccggctacctgccgggcgtcaacatcttgaacggcgcctcgctcacactgcacgacggcgagatcgtgggcatcatcggcccgaacggcgccggcaagtccacgctgctcaagtcgctgttcggcctcgtgcacatccactccggcaagctcacgctcaaagggcaggacatcacgaatctgcgtgccgacaaactcgtctcgcggggcgtcggcttcgtgccgcagacggagaacgtgttcccgagcctcacgatcgccgagaatatgcatatgggcgcataccaggcgccgaagctgttcaacgaacgcttcgactacgtctgctcgatcttccccaagctcggcgaccgcaggaaccagctggcgggccagctctccggcggcgagcggcagatggtggcgatggggcgcgcgctgatgatgcagccgagtgtgctgctgctcgacgagccgagcgcgggcctgtcgccgatgatgcaggacgagaccttcattcgcgtgcgccaggtgaacaaggccggcgtctccgtggtcattgtggagcagaacgcgcggcgttgcctgcagatctgcgaccgcggctacgtgctcgaccaggggcgcaacgcgtactcgtgccgcgggcgcgacctgatgaacgacccgaaggtcatctcgctgtatctgggcaatctggaggaggaggtcgagaaagagaacaagtgaaataaaatggaaacaatctgtaaatgaaagcataatattactagatatactaataaatataactaaatactataactgaagatgaaaaatattatgagatgagagatgtgccggcgaacggcggagaagagagaagactgaaatgcgactggcaaacaagatgaagatgttgacggcaatgaccgcggcggcactgctcgcgctgtcgggatgcggctcgtcgggcggcgcgtccggcggatcgtcgaacagcgtggcgtcgagcggcgacggcatggtgatcggcgcactgctgccgctcaccggcaccctcgcctacctggcaccgccggaggtggcggcgatcaagctcgcgatcagcgacatcaacaaggcgggcggcgtgctcggcaaggacgtcaccgaggtcgaggccgatacgtcggacggcgagcatgccgaccagaacacgtcagccgcgcagtccgtgctgtcgaagcacccgtcggtcgtgatcggacccgccgcatcgggcgtcgtcaagaacgtctacaagagcatcgtcgccgagaagatcccagtgatctcaatggcatcgacgtcgatgacgctctccggcatggacccgtacttcttccgcaccgtcgccccggatgccgtgcagggcgcggtgatgggcgacctcatcgcgcaggacggcgtgaagaagctcgccatcgcctgcttcaacgacgagtacggcaccggcatgcgcgacatcattctgcagaagctcaaggatgccggcgtcgacgtggtgtacggcgagaaggacgccttcgacccagccgagacgaactactcgtcgatcgcgacggcgatcaagaactccggcgccgacgcgacgctgatcatctcgtacgatcaggcgacgccgctgatcaaggcgctggcctccgccggcgtggacacgcacaagctctatctagtcgacggcaacaccgtcgactactcgaagacctacgacgccggcctgctcaagggctcgaagggcaccatccccggcacccatgtcgacgacaagttcaagtccgacctcaagggcaccggcaccgacatctccgacaccacatacgccgccgaaacctacgacgcagtgatcctcgccgcgctcgccgccgaacagggcggcagcaccagcggcgagacggtcgcgaagaacctctcctcggtctccggcgccgacggcggcgagaagtgcgagagcttcgaggcctgcaaggcgctcatcaaagacaagaagaagatccagtacttcggcaagaccggcatcgggcccttcaacaagaacaacgacccgagctcggcgaacatcggcatcttcgagtacgacggcaacaacgtcaacgtcttccaggacatgcagagcggcgacgtgccgaccgagtgacttaccatccctctcctctatacgaagggctgcccacaaggcggcccttcgctgtttttgcgggtcgggcgccgacctcagcgacgggtggtggcgcgctcgtgcagcgtcaccgggatgatcgtcatgttggcatcgccgtccgtggcatccgggcgttgcggcgaagactcgatcccgtgttccacgcacgcggcgatggtgtgcgcgatctgcctgaaatcctgggcgaccgtggtgagcggcatgccggcgcaatccgcggcgagtgtgccgtcgtaggcgatgatctgcacatcaccgggcaccgcgatcgagcgcgagaccgcctcctgcacggcgaatgcggcggcgagatcggcccccacgaacgcatccatgtccgggtatgtgtcgaatgcctcgcgaaccgcacgccgcacgccggcgatgtcgaacacctcgcccgactcgatgtacgtgtgcgcaatccgcgcttgggaaaggcggtcttccaacgtctgtacatagcggacggtggggaaggtggagtggtcgccgaggtcggtgaattgcgcgcgcgggccgcccaccatgaccacatggtgcgcgccggtgcgcacgaggagttctgcgatgagctcgccgccgtgcacgtggtctgaactcacctgagtgatccccgcccccagattgcggtcgaaggcgaccaccgggcggtcgatcgcgcgccaatactgcgggtcgtgggtggtgtgcgcggcgacgaccagcgcgtccagactgtgccgacgcagcatgtcgacgtactgcgcctcgccgttcgcggagtcggcggtggagcacagcatcgtctgcagaccgcggtccgcgaactcgtgctgcaggtgcgcggtgagcgtggcgaagaacgggtgctggatggtgggcacgatgacgccgatgatgtcagtcttgccgtggtagaaattgcgcgcgagctcgttgggcacatagtcgagctcgcgcatggcctgctcgaccttctcgcgcatatcgcgtgagacatagccggtgccgttgatcaccagcgagacactgctcaccgagacgcccgcccgtttcgcgacatcgcgcatgccgaccatgttcgcctcctcattttctgctccgtgcgctatcgcccgcggtatcgaaccggtttgacgagcactatccgattgtatgtgcagatttcgtcctccggcaaccgcgtttcggcagagcgcggtgaatcgtcgaatatcgaaccggtttgatacgccgagagcagagcgcttgcatgcgcgtgaagaatgaggtaaaacaatactcgaaccggttcgatacggcagctcgcgcaacgatgaagcttcaggcagacgcatcgccccggagatatcccgaagacgtgatagacgaatccaggaggagccatgaagaacaaagttcagctgatcacctatgcggatcgcttgggtgacggcaaccttgcttcgatgaccgacattctgcgcacgcgattcgacggcgtgtacgagggcgtgcacattctgccgttcttcaccccgttcgatggcgcggacgcaggcttcgacccgatcgaccacaccaaggtcgacgcccgcctcggtgactgggatgacatcgccgagctcgccaagacgcatgacatcatggtcgatgccatcgtcaaccacatgagctggcagtccaagcagttccaggatgtgctcgcgaacggcgaggattccgagtactacccgatgttcctcacgatgagctccgtgttccccgacggcgcgaccgaggaggagctcgccggcatctaccgcccgcgcccgggcctgccgttcacccactacagcttcgccggcaagacccgcttggtgtgggtcacgttcacgccgcagcaggtcgacattgacaccgactccgccaagggctgggaatacctgatgtcgatcttcgaccagatgagcaagtcgcacgtcaagtacattcgcctcgacgccgtcggctacggcgccaaggaggccggcaccagctgcttcatgacccccaagaccttcgaactcatctcgcgactgcgcgaggagggtgccaagcgcggtctggagattctcatcgaggtgcactcgtactacaagaagcaggtggagatcgccgccaaggtggatcgcgtctatgacttcgcgctgccgccattgctgctgcactcgctgttcaccggcaaggtggacgcgctcgcgcactggaccgagattcgcccgaacaatgcggtcaccgtgctcgacacgcacgacggcatcggcgtcatcgacatcggctccgaccagctcgaccgttcgctcaagggtctggtgcccgacgcggacgtcgacaacatggtcgagacgatcgcgaagaacacccatggcgagtcgaaggccgcaaccggcgccgccgcttcgaacctcgacctctaccaggtgaactccacatattattcggcgctcggctgcaatgaccagcattacattgccgcacgcgccgtgcagttcttcctgccgggcgttccgcaggtgtactatgtgggcgcgctcgccggcgagaacgacatggagctgctcaagcgcacgaatgtgggccgcgacatcaaccgccactattacacgacctccgagatcgacaagaacctcgaacgtccggtggtcaaggccctgaacgcgctcgccagattccgcaacgagctgccggcgttcgacggcgacttcagctactcggtgggcgatgacgagtcgattgcgttctcctggaacggtttcggatcctccgctacgctcacgttcacgccgtccaagggcatgggtgtcgagaacccacagtccgtcgccacgctcgtctggacggattccactggcgagcaccgcaccgacgacctcattgcgaacccgcccgtcatgcaggcgagctgatgcgcggttcccgatagagattccagatattttcagattcccggaaaagagaaatcatggttgacgaacaagacacccacggagggagcgcgccgtcgacgggctcgaacggctacattcgcccgggcatcgacgaccgccccgacttcgacaaggtattgagccaggaagacaaggagaacatctcccgtctcaccgcgccgatgccgaagaagcgagccgccgacagcagtgtgggcgacgagcaggtgcagggcaccaaactcgccaccgattcgcaggccgtcggctccggcatggcggcgctggccgcggtggacacggcggtgccggacgaggcgtccgcattcatggacatgcgcgatccgatggtctcggccgacggccaccgcccgaccaaggccgaactcgtgcgcttgggcatcggcttcaccgtttccgcagtcgcctgcgcgattccgtgggtggcgctgagcaccgtcattctgccgcgtgtgttcgagctgattgacaactcgagcaaggaagccatgctcggcttggtcaactcgatcggcgcgattgtggcattgctggcgaacatcatcttcggcacgctgtctgacatgacgcgctcccgcttcggcaagcgcacgccgtggatcgtgggcggcggcatcatcaccggtcttgccatcggggccatcgcattcacgcgcaacgaggcgttgatcatcttcctgtggtgcgtcgcccagatgggctacaacatgatgctcgcgccatacgtggccgtgatgtccgaccgtgtgcccgacaaggtgcgcggtacgatctccggcttctacggcgccggcatcgccgtcggccagacgctcggctcggtcgtgggtgccgcgttcctgcgtcaggggcagtcgggactcttctccgcatggatgatgggtctgggcatcttcagtctcaccggcatcttcgtcgtcgccatgtggccgcgtgagaagtcgagccgcttcgaggagcagagcgagcatgtgaccgtgaagtccgtgctcctgaacttccggccgccgcgccacgcccccgacttctactacgcgctcgtcggccgcacgctcatgatgggcggctactggatgatcacgacctaccagctgtacattgcgcaggactacatctacgccggcgatccgaatgcgaaggacaaggcggctacgatcatcgccaccatgggcgtgatcacgctcgtcgtctcgctgatcgccgccgtcacggcaggcccgatcaccgaccgtctcggcaggcgcaagctgccggtggcgctcgcaagctgcctgttcgccgtcggtgccgcgatgccgctgttcttccgctcgccgatgggcatgtatctgttcgccgccgtcgccggcctcggttacggcgtctacaacgcgatcgaccaggcgctcaacgtggccgtgctgccgaatccgaaggaagccggcaaggatctgggtattctcaacctcgccaacacgctttccacagtgatcggcacggcaatgacctcgctcgtcgtctccatcgtcaagagctcgatgcacgtctccaccacgcccgccgtcgcctacgcatgggtgttcggcgtcgcgatcgtgattgtgctcgccgcggccgcactcatcatgcgcatccgcaacgtcaagtaatcccttacctctctccagaccgcaggccggcagcgttcgcgttgccggcctgttccatatcaccttgtgtttcgaacgcttttccgcgttcatgcgagcgtaacgcggcgctcacgcgctcggtttgtggcgcacgtaatctgcagacagattcacgcaagaagtctagggatgtgaatcgaaaccaccgcttcgcctgcttgcgaagagttgcattcgcagattcgcgcgggcaagagatcagagagaggaaacggtgattgcaatgaacaatgcgaaaatcaagtcatggatggtcacggcgacggcaatggccgcggcggcgatgctcacgctgtcgggctgcggctcgggcgcggaaagcaaggcggacgccgacgaggccacgttcacggcggccgggctcctcccgctcaccggctccatggcatatttgggaccggcgaacatcgcgacgatgaagctcgcacagaacgacatcaacgcggccggcggcgtgctcggcaaggacatcgatatcgtctcggccgacacctcggacgccgaccacgcggaccagaacacgtcgtcggcgcagtcggtgctcgccagggagccgtcggtcgtggtcgggccgccgtcgagctcggtggtgaagaacacgttcaagcaggtgacgtcgtcgcaggtgccgatgatctcgtcgggcgccacatccaccgcgttctcgggtctcaacgactacttcttccgcacgattccgccggacacggtacagggcgtggtgctcgggcagatcatcgtgcaggatggcgtgaagaacctcgccatcgcggtgttcaacgacgagtatggcacgtcgctgcgtgacgtggtggccaagaccgtcggcgatgccggcgtcaacgtggtgtatggcgagaaggagaccttcgacccgaccgagacgagcttctcgtcgatggtcacgaacatcaagtccacgaagccggacgcactgcgatagtcggctacgcggagccggatgccgacgcgctgttcgtgcgtctggccgacgaagcgtacgcactgggtgcggccgagaccgccgacacctacctgaacatcgacgcgatggcgagcgccgccgtgcgcgcacacgccgacgccgtgcatccggggcacggattcctcgccgagaacgccgacttcgctcaggccgtgatcgacgcgggaatggtgtgggtggggccgaagccggagacgatccgcgtgctcggctcgaaagtcgcggcgcgccggatcgccgccgaagtggtcgagttcgcacgcgaacacggcttgcccatcgcgatcaaggcggtctacggcggtgggggccgtggcctgaaggtggtgcacgagcccgacgaggtggcggccgccttcgaatcggcaatgcatgaggccgaggtggcgttcggcaacggcgattgcttcgtcgagcgcttcctcgcacggctatggcatgtggaggtgcaggtgctcggcgaccagttcggcaccgtgctcgccgtgggcacgcgcgattgctcgctgcagcggcgcaaccagaagctcatcgaggaggcgcccgcaccgttcctggctgccgagaccgtgcgggagctcgagcgcgccgcggtggcgatctgctcacgcgcgcactacgaaagcgcgggaacggtggggttcctcgtcgacgacggcacgatgagcttcatggaggtcaatacgcacatccaggtggaacaccccgtcaccgaggcggtcaccggcgtcgatctcgtggccgcccaactcgccattgccgagggcgcgccggtggaggcggtgcccgggcttgaatccggcgtcacaccagagccgcggggggggcatgcgatggaattccgcatcaacgccgaagacccctcactcggcttcgtgccgttccccggcgtcgtcgaaagcctgcaggtgcccaccggccccggcatccgcttcgattcgggcgtcgcggccggcgactccatctcaagccgttacgattcgatgatcgccgagctcatcgtcaaggcctccacgcgcgccgaatgcctgcgcagagccgaacgcgcgctcgccgaactgcacattcacggcgtgcccactgtggtgcccttcgacaaggcggtgctcgaatcagcggatttcggcgcgggtgcagactggagggccgacgacgatgtgtccaatgcgaatttccgcgtgtacacgcgctggatcgaggaggaactgctgccgaatctgccctcggaaacgcttgaggactggcgtcgcgccggcgagcgggcgatgggcgaacgccggcgggccgggtaatccgggggtggattcaggcctgctcgccgcacggctcggcggcctctcccgtcccgcgcccacatcggacgccaacaccgcggcggacggcacgccggtcacggcggaactcggcggcaccgtggtgcgttggctcgccgacgacggcgccccggtgcgcgaaggcgacccgatcgtcgtgctcgaggcgatgaagatggaacgcgaagcgcttgcgccggcaccggaacgcttcatatcaccgtgccggtcggcgagcaggcggactacggcgccgtgctcggcacaatcgactagcgggcgcatctgcacacggcaatcggcaaccgaacattcatcgaggagaatatgggcagcatcacggactggagtaaatacccacgcatctcacgcatcgccaccgcggcggccgccgacgtgggacgcgggtcggaaacactgatgacctatgtgcgcggcgacctgtttcgctcggcacgccatcttgccctcggcacggagcagccgcggcgtgctcgacgcgagaaccggcgcaaaactaagcgacccgcacgcgcgctcgtcgtcaccggattctacattccgcaggcgcagcagccggccgccgaaacggacggaccgctgggcgcactcgaagtgtgcatggcactacgcgcggtgggcggcgacgcgtggctcatcagcgacgaacattgtgcgccggtcatctgcgcggcggcgggcgatctgctccccgaggaccgcgtgctcatcgcgccgcatgcgaaacccgaattcgacgcatggttcaacatggtcatcgatctggtgaaacgccacggtatagacacgctcgtgttcatcgaacgcgtcgggccggcgcgcgacggcagaccgcggaacatgcgcggcgtcgacatcgccgaatggacggccccgctcagccagctcgctttgcttgaattgcatacgataggcgtgggtgacggcggcaacgagatcggcatgggacgcgtggccgattatgcgatcagcggcgtggtcgcgcacggcgagagcatcgcatgcacggtggcggcagaccagctcgtcgtcgccggcacgtcgaactggggtgcgcatgcgctcgtctgcgccatgcgcgcgctgggatgcccgcaggtcgagccgtacctggaacccgattggcaccgcgccgtgctcgacgcaatcgtcgcggcgggcggcctcgatggcgtgcatatgacgaacgtgcccacggtggacgggctcgacccggcgcgctatttcggcacggtcgcccagctgagcgccttcgccaggcattaggtaatccgaaccagcgcctgggtggcagaatagagaacggcgaattcactcggcgttcatcgaacgccgggcatggcgcggcggcgagcggttactgtgggaaatatgagtaatgagagcaagaacagcaatgattccgcagtgccgcagtcgcagcaatcggaaccgcagaccccgcgtacgttcccgaaatcgaactatattcgccccggcattgacgaccggcccgatctcgacaaggcgctgagtgccgaagacaagtcggcggtcgcgcgcttggccgtgcggcagaagccggtcaccgcaccgcccgccgccacacacccggaggtgcaggccgccgcgctcgccgatgcggccggactgtctcacccggcctccgacgagccgattcccgacgtggaatccgcgttcttcgacctgcgtgatccgatggtcgattccaccggctaccgcccgacgcacacgcaggtgttgcgcatgaaaagcggctttgccgcggcgtcgctgctgctgtcgttcgccatggtcgcgctcaccgtggtgcttgtgccgctgcgactcgacgaattcggcggcgctttcgacggcaccgtgaatctggcggtgctgattggcgtgggcattgtggtcgcgatgttcatgacggcattcgcctccgcgatgtcggaccgcacgcgagcttctctggggcgtcgcacaccctggctcatcggcggcaccgtggtcgccacactgtttgcattcgcgctgtccgcatgccatacgaacgtcgcgatgattctcgtctgggtgttcatgcagctcggctatgcggtgatggcgatggcgtgctccgcaatggtgggcgagatggtgcccgacaagttccgtaacgcggtggccacgtggcgcaatgtcgccatgttcgcggggtcgctcgccggcgctgcattcgccgctggcatggcagaccatgtcgaggccgcgatggacatatgcgccggtgccatactcgccgccggcgtcgtcgtgctgttcgtgccgccgcgcgagcattcgagcgaatacctgcacgtcactccgctcgacgaagacaagctgctcgtggccttccgcgcgccgcagggcgtgaggcactggggcgtgatcgccgtgatccgcctgctcgtctcggccacgctcgccgtctcgatcacgtacgtggggttcctggtgcgctatgagcatggggtgcatgccccgaattcactgcagtacacggcggtgacgattgccgccatggccgtggtggcctatgtgctcgccgcgatatcctccgtgctgctcgacccgatcaccagccgattctccagtgccagggcaccgctcgccctcgcgtcgaccgtcatgcttctcgcgtcgatctgcggcatcgcgatgcccaatcgcgccggactcatattgttcgccgcattcggcggctgcgcgctggccatgctcgattcgctcgcgcaaacccaggcgcttcatgcgatcgaagatctgcagcacaccggccatgtgctcgccgtgctgcacagcctcgacagtgtgggcagactgctcggcgtcgtcgtcggcgcgattgtggtggttgccgcagacgcatttgccccgctgttcattgtcgccggcgtgctggcgttggcgctgctcgtcgttgtgctctgcacctcctcgcgtctcgccgactgacggggtctccggcgcgcgctcagagcgttcgtgggtaattcggcatgcggaaatacattcgcgtttcgccgttgaatccttcgaaccccaatgaatcgtagaacattgtcagattgctgttcagcggatccaccaccagcgcacgtatgccaatcgtcagactgagctgaagcgtcctgtcgaccgcgtcgcggataagcgccttggccaatccccggtgttggaagtggttggcaaccgcaagttgcccgaggagcgccgccggtaccagaattggggaattcctgcgcatccacggcgcatacgtttcgtcgcgtgcgaccgttgtggagctgagcgtgtacacgccggcgagctcgttcgtctcatgatcgtaagacagatacaatgcggcgcttccatttttgttggaggcgttggcatggtgcttcagccagtcgttgatctgctgttccccgcagtcgaatccggtgaagtcgacagggcactgggcgcgttccgggcgagtgaatggcatcgcggtcatgcccattccggctgatatgcgaggaactgctgctgtttctcggtcaatggcctgtccagattctcgacgaacctgtcgaaggcctcatctgataggcgaatgatggcgttggcgtgcaggtcgcgtttggcgtcgttgatgaggttgttgatgcaccaggtggtgaggcgagatcccgtcgcagcgctggcctgttcaatgagtcgtttttcctcttcggtgagtcgcatgtcgatgcgggcggttcgtgtcatggttgccatgacaatattgtacggcattacgccgtacatttcaaaatctcagcagcgggcctgcgtgatgatgtaggcgggccagaacgtcgagatgagggcgaagcgaatgtagtaggcagagggctcgtaatcttcggtccagaaggtgagcagatgggggagggcaaaccagattgcgagaaatacggcgacgcaaggggcgatagtgcaggcgcgggcgagcggggtcttatcgcgctcgaggcaggcggcaagcgccgggaacgggagaacgacgcataggatccacaatcccagtgagcagctggctattgtgatttcgcgatgccgctgaatcggcgtggccggacatggactgattggcgcgcaatcaggaggattgtcaggagcgttgttttcgctgccaacgaaggcgcaccatccccgaaacagcacgggagggatgtcgaggaagaagacgatgccgcgaatccatgacagcgcgaccgaaggtttgcggaagcgtgaggtggtgcgagctggtgccgatggcacgggagcctgtgatgtaggtgaggtcataggtgtgcggtgggattcatcgggcatggaacgagtgtagtgtatggagatggcgtgcgtcgccctagctgtgcgcacccatgatgccactgggcgatatggcttgttatgtctatgcattgaaagcaaaagtgccgcattatatctcgctgaccagattcgaaaatctcactatatggacacctcgtgcgctcggtcgcaggccagggagtaggttctaacccaacacggcgccgcggcaagcgcgcgccgcgcacagcaacgcaaacggatacgcggaaaggaggctcgcgatgagtgagaccatggtcgcacgactgcagattgtacgaattattatctcgccatcggcgagctgattcgtatacccagaatccagccctgccgatgtggcagggcgacgcacatgacatctcgaaccctgccgaagagcagggttttgcatatcgcaacacagaaagaaggagattcatgaccgcggtcgaaacggaaacggaagcggggcgccgcgccccggcgctggcgggggagcgcgcgcatgcgctcagacgggcgggaaagtcgtcggtgggcacgatcatcgccgcctcgatggtgggcacgacgatcgagttctacgacttctacgcctatggcaccgcggcggcgaactacttcccgcgcgtgttcttctccgatgcgacgaacccgaccgtcgcgctgctgctctcgctcgtcactttcgccgtcgcgttcctggcccgcccggtgggctcgctcatcttcggtcatttcggcgactcgatcggccgcaaggcgaccctcgtcgtctcactgatgaccatgggcgtcgcgaccttcctcatcggctgcctgcccggctacgacatgtggggcgtgtgggccgtgctcgcattgtgtgtctgccggttcgtgcagggcatcggactcggcggcgaatggtcgggcgccgcgctcgtggccaccgagaacgcgcctgcgaacaagcgcgcgctgtatggctcgttccccgagcttggcgcgccgatcgggttcttcctgtgcaacggcacctatgtgctgctcgagctgttcaacgatgacgccgcgatgctcgcatggggctggcgcgtgccgttcctgctctcgtcgctgttggtggtcgtaggactgctcgtgcgtgtgcacatggaggagaccccggcattccgcgccgcgaagcaagaccagcgcgtcgtcaaggcacctgcgctcgaggtgttccgcaccagctggcggcaggtattgcaggccacgttcctcgtcgccgtcacctacacgctgttctacacgctcgccacatggtcgctcgcatgggccacgaagagcgatgcgcagggcggcggtggactcggcttctccaccaaggagtacatgacgatgctcatggtctccgtctgcgtgttcgccctgttcatcgtgctctcctgcgtgtttgcagaccgcattggccgccgtcgcgtgatcatcggctcgtcggtcgcgctgctcgcgttcgccgcattgttcccgctgctcatgaaccgcgccgtggtcggcgtgcacaacaccgccgccgcaatgctgttcctgtgcctcggctttgcgctgatgggcatcgccttcggtccgattggcgcattgctgcccgagctattcagtgtgaacgtgcgctacacgggctccggcatcggctacaacatcgccgcaatcgttggcgcggcgttcgtcccgtcggtcgccacatggctgtcgtcgcactggggtgtcggctcggtggggctctatctgggcgtcatggcgctgtgctgcctggtggcgatcttgacgtgccgtgagaccaagaacgtggattacatgcagtgaacatatgaatccttggaatccgtgtgagaggaaaggagttcggcagggcaataggaaacagtccgatagggataggcaatacgtaatacaaaatgtccagaatatggtcaatctatctccgcggtaatcaatgatctatggacgaatgcccggtattttccaaaagaaacggagggcgttccaaaacgcggcaccgccggtatccaaaagatggacgcgatgcgggcgtgcgtggagatttcggtaagatgagatttcagttttggggacaaaatctccaacacatagggattacagacgccaccgcccgagcgggccaacacggcgcgaccggcgcggcggcagacaacatcaagcatgggcatgggctaggaggcccacgccgaacacaaataaaaggagtgtgccacatggcagcacagatctggtacgaagacgacggcgatctttcggttctcgacggcaagaaggtcgcaatcatcggttacggctcgcagggccacgcgcatgcgctcaacctgcgtgactccggtgtcgacgtcgtcgtcggcctgcgtccgaactcgaagtccgtggaattcgccaaggagcagggtctggaagtcaagagcgttccggaagccgctgccgaggccgacgtcatcatgatcctggcccctgaccagtaccagaagggaatctgggagaacgacatcgagccgaacatcaagccgggcgccgccctggccttcgcacacggcttcaacatccactacggctacatcaagccgagcgaggaccacccggtcttcatggtcgccccgaagggcccaggccacatcgtccgccgtgagtatgtcgcaggccgtggcgtcccggttgtgaccgcagtcgagcaggatccgcgcggcgacggctgggatctcgcactggcttacgcgaaggccctcggtgcactgcgcgccggcgccatcaagaccacgttcaaggaagagaccgaaaccgatctgttcggcgagcagaacgtgctgctcggcggcgtgaacaagctcgtcgaaatgggcttcgaggtactcaccgacgccggctaccagccggagatcgcctacttcgaggtgtgccacgagctcaagatgatcgtcgacctcatgaacgaaggcggcctgaacaaggatcgctggagctgctccgacaccgctcagtacggcgactacgtcagcaccgtcatcgacgagcatacccgtgagcgcatgcagtaccacctgcagcgcattcaggacggctccttcgccaaggagttcatggacgaccaggctgccggcgccccgaagttcaagcagctgcaggaggagtactccaacgtccgcatcgaagaggtcggcccgaagctgcgcgccatgttctcctggaacaacgacgccgcgaaggacgccgacgaagccaactccttcaccggcaagatcgcccgcgcccaggttcagtgagccgcgtgcggtgcgtccgcgcatgaagccgtgagcttcgcatctgtcaaggtggggcatgcataggcatgccccaccttttgcgttctcctgcattgagcggccttctgcactgagcgttctcccgccgtggcgcagtttgcggaagtttccgtgaaccgcgccgcaaagcaactcgcgcgcggtagttttcgcggatgcttccgtttgtttgaccgcaaatgagggcaaaagtggtaattctttcggatgattccgtaagctgtgccgcggaggtgtctgcaaacggcatggttttcggatggttccgtgtgtttggccgccgatagacgcagtgacggcatatctttcggacgcgtccgtgtgctatgccggggcgcgggctgtacgtagcagatttcgcggatgcttccgtaagctgtgccgcggagcggtctgcaaacggcatatcgtacggaagactccgtgaaatagaccgcgtatgcccgcatgcatggtggattacccggaagtttccgagaaacgagccgcagtcatagctgcggctgcccgagacgcgcgccggtgaccgcagtgatctcggcaaccacggcagccgcggcatacaaccggagcataggcggcaatgaccgggctacttggcgaacgggaacgcgggcaggccgtcgtcgttgaacagtggtgccggaccccagctgcgccaggcatagcgcgcgtgggtcggcttcggcacctccggtgagaataggtgcacgacgcgcatgtcgctgccgagatcgtcgctcggctcgatgcgcgcgtgtgccgggacgaactcggagtccgcactcgcggcgatctcgaaaccggattcgccggccttgcgctcggtgctttcggcaatgtccgcaatcgcgcgcatggaatccggcgtcgtgccgtgccaatggagtccctgcgcatggttgaacgtggcgaccatctcgccgccgccctcgctcacctgcagatcgacgagctcggggctggcacagggaatctgcagaccgtagacgtcgtgcaatgccgtgtcgccgagccgcatgccgagcgtgcgcttgtcgacggggtggatgttgtcgaattcgccgcagtccatggcacagacgatgttcgtgtgcggtgtttcacgtgcaacagtgaactgttcgtcgcgcagtaccggccaacgcagcggatcatgttcggcgttggccgcggcgatccactgcggcaactgcaccacgaggaacggcagcgcatcgtcatgccatgtcgtgcgccattccgcaatcagaccgcgcaacagctcgccgtacccagccgcgttgagttcgtcctcctcgccttggtaccacaggattccggcaagcgtatacggtgccacgcggcggatcatcgcctcgtacagcgcgtacggcctgcgctcggcgaacggcgtgactggcggcggccatgggcacgggccgagcatcgcgtcaatctgcggctgcgaataatccgggtgttcctccttgacggcggcgacgtcggcgttccacttgtcgaacacctgctgccaggcggtctgcgcggcgagcatctcctcatccgtcttgccggcaatcgcgtcacgatatgcctgtagatacttacgcccgagcccggtttgctccagcagatgctcgctcatccatgcgctgatcgacgtgccgccgatgtagcaatccacgacgccgaccgcaatgccgttcgccagcgcgtcgcgcagctgcttgccgaagtagtagccgatggcgctcatgtgggcgacttgcggcgcttcggcggtctgccaaccggacgcggattccgtggccagattgacccgcgcggacttcggcgtgttgtagaagcgcagcagtgggtcgtgcgcgtcggcgacggcctccttgccgaattcgctgttgtgcaactcgaactcgatgttgctttggccgccggcgagccagacttcgccgaccatcacgtcgtggaacacgagctcgtcggcgccgcatcgcacgcgcaatgcgagtggtccgcctgccggcagcgcgggcaatgtgagcatgaacgtgccgtcgccgttcgcatggttttcagattgcgcgatctcctgtccgcgcgcatcggtgaggaatgcggcgacgacttctccagcgggtgcctcgccgaatacggcgatcggcttgccgcgctgcagcaccatgtggtcgctgaatatggcgtccacacgcagattgccgcttctggtgcggtcgtgcgcgccgtcgttgtcgctggtaggttcggccattcccgatgcccccggtgcgatgccggtcacagttgtcatgttgtgtctccttatgcgtctgaaagcgttgtcgatggtttctcggtccccaccctctcggcgctgttgtgcagggcgcccgggcgcggtctcgtcactggatcgcaagcgccctttacgttcctcaaccccgcccggccgccctgcacagcagcgccggttcgaggcggaatgcatggtggggcagggggggcttcgtgactcgatccgttcctcaaccctgtccctccgcccggcatgacgacacctgtttcagacgttctggatattcgctggttaggtcggagagcgggtgggtcgtaccggtggttccctgaaggtcggctgggtagggttgaggaacgtaaagggcgcttgcgatccagtgacgatgccctacccagccgaccttcagggaaccaccaaggggtgagtctcagtgaactattgccacagctctgcgccgaacgaatcgatgtaggcgaccagttcgcgcgccatctcttcgtcctcggcaatgcgggggtgccccggggtgccagttcctgcgcgcgaataatcgaagtgcgtaatctgcggattgtcgagctcgctcaccacttcgtcgatcgcgcggtcccagttgcggtcatgctgcagcacggtcgtcgtgcagatgatatgcgcatccgggtaccgttcgagcagatcgcccaggaactcggcatagcgggcgcgccagttcgcggcctgctcgccggtgtaatctgcggccatgaaatcgtacgggtgcgaatcattctggccgagcgccacaatgaccacctgcgggtcgtcgtcgcggaaatcccagtcggtgggctcgccgagcgcgggattgtactgcacacgatcccagatgctctccatgccgaggtaatcgggcgcgttgaaccagccgatgccgtcaagcagcggtgcgccgccttgtgagatgatgcgcaggtcggcacccaatgcgcgggcggcgatggcatcgtaggcgaaccatgagttgctgtaggcgctcagatcttcgtccgggtcggccttgccggtgcagagcacggcctcgttgcgctcgccgcagctcaccgagtcgccgtacacctcgatgcggcgtgtgctggcgggttcggcaggtgcgagaatctgcgcgtcgtcgtcaatctccacgccggcgaactccatgtagtgcatgccgccatcttcgcgcttgaatacgattgcgcggtgctcgatgttcggcaagtggcttgcaatgcgaatggtgagcatgccgtcttcccccacgctcacggcggcgtcgggctcgggttcgacgggcgacggcacacgcacgctgaactgggtgttgtcgatgatcacaccgatgcgcgtgtggccgtagttccagaaattgcgaagacgcacggcgagggaggtgccggtgaagcggaaccgcgcctgcgtgtaggggaacacccacagcggcaagtggttcttcgattcgccgatgcgtcccatcgtgcggaaagccggattgaatgcgtcaatgaattgcatgctgctccttatgtgtctctgctgtgccgattatatgcctattctcgcggtgtcgcggccctcactttgctgcgaaactctgttgcgaactctgttacgggccaagtttgtgcgtacgggctaggattttcggttacgggctagggcatctctgccttttcgtgaaaaacgggtagtcggaaaccgccatgttccaatgatcccgtttgccggggccccgactttctttagcctgtaacgcaaaatcgtagcccgtacgcacaaacttggcccgtaagcaagaagttagcccgtaagagatggggaatctggcccgtaacggatggaagagagcgggggggatgtggaagattgttggcgatgcgcgtgttgcgggcggtgtggaggggaggagcatgctatatttggcatatgctgactcgagagtaagtaaatgaatgccggagcagatccgggatttgcgcgggtctgtgctcggatgcgacgtgtattgtgtcggatgtatcgacaggaggaatcagcaatgacgatgacgttcccgaagggcttccagttcggcaccgcgactgccgcctaccagatcgaaggcgcggtggacgaagacggccgcacgccgtcgatctgggatgtgttctcgcacgccccgggccgcgtgctgaatggcgacaccggagacaaggccgacgatttctaccaccgctggcaggacgatctcaagctcgtgcgcgatctcggcgtgaacgcataccggttctcgattggcgtgccgcgcgtcattcccaccccggacggcaagccgaacgagaagggcctcgatttctacgagcgcattgtcgaccagctgctcgaatacggcatcgacccgattgtgacgctctaccattgggatctgccgcagtatctgaacgaagatccgtaccgggatggctggctgaaccgtgagaccgcgttccgcatggcggagtatgccggcattgtggccaagcgcctcggcgaccgtgtgcacacctacaccacgctcaacgaaccgtggtgctcggcgcacctgagctacggcggcaccgagcatgcccccggcctgggcgccggcccgctcgcgttccgcgccgcccatcacctgaatctggcacatggtctgatgtgcgaggcagtgcgtgccgaggccggagcgaagccggatctctcggtgacgctgaatctgcaggtgaaccgcggtgatgcggatgccgtgcaccgcgtggatctcattgccaaccgcgtgttcctcgatccgatgctgcgcggctactacccggacgagctgttcgcaatcaccaagggaatctgcgattgggacttcgtgcatgacggcgatctcaagctcatcaaccagccgattgacgtcctggggcttaattattactcgacgaatctgctcgccatgagcgaccgcccgcagttcccgcagagcaccgaggcctccaccgcgccgggcgccagcgacatcgactggctgcctaccgacggcccgcacacgcagatggggtggaacatcgacccggatgcgctttataacacgctggttcgcctgaacgacgactacgaccacattccgctcgtcgtcactgaaaacggcatggcgtgccccgacgaggtggaagtcggcccggatggtgtgaagatggtgcacgacgacgaccgcatcgactacctgcgtcgccatctcgaggccgtccaccgcgcgatcgaggagggggcgaatgtcatcggatacttcgtgtggtcgctgatggataatttcgagtgggcgttcggctacgaccgccgcttcggcctgacctacgtggactacgacaccgaggagcgcatacggaaggacagctacaactggtaccgtaacttcatcgccgagcactccgccaagtagcgggttcgggcgcgccgggcgcgggtcatgcaatgtctgtggatatgcacatgtatgagcatgcacagacgagttgcatattcgcgcccggctcgttttgatttcaggatgtggacggcgcgtcgcctgaagcgattaactatttgggattacttgcagagaatctcacccagttttgtgtgacggtctaataaatttgaaatccgcggaaattcgggaaagcgcggcggagaggtaatttgcggcggtgtgaaatctgaggcaaattggctcggtaaaagaacttaagcgcttgataaactcgggtgaggggaattattctttcaatcatcgattcgcaagcccgcgaagctgcggggagcgaattccggcaaggattcaaggcagagtcattgccagggacaacatcccacaatgagaggaagaaccatgaaggtcaagaagatcgcagccatagctctcgcatccgcatgcgcattcagcatggcggccgtcgacttcaacggccaccgcaagccggtctggtatgcctcccgcgacttcttcgcaccgcgtctggccacgatccagccgcgcacctcggaggagtaccgcgagacccacagctgggagggtgtgaaggtcgacgccgatcacctcgagctcatcgtgctcaacgacacgaacgagccgtacaagggctcctgggcggtcaaccgcgtcgacttcgacggcaacgtgctcgccacgcagcagatcgacgacgtggaactcgacgccgccagccacaagggcttcccgctgaacgaggagattgtcgacttcggcgatgcgaacaacgaactcatcgttgccgtgccgtccgacgattccttcgcccgcgtgatctacaacccggccgaaatcctcacgcaggagctcgatgccccggccgacgcgttcacgaccaaggccaagcgcaccgccgacggcgtggaactcaccgtcaccgcgaacgactacgtgcgtgacctgttctgcatggtcggcaaggtcgacgacaaggcgaccgttgaggaaggcctcgtctcgctgcttccgggcgaatcggtcaccttccacatcggcaccgactacgcgggcgatccggccgatttcgccgccgccaacgtgctgcgtagcgcgaacgacctcaagcgcgacttctagtcgcatgccgcggggaatctgcaaacttcagtaatttcagttcgcagattccccacagacgcctcttcaggcaacccggccgcgcgtatgcagcgactgcctacgcgcggcattcccgtatcgcatatatgcgaagactgtgtgaaaacggggatgccggctacctggcaacgtcaacgatgacataatttgttaagtaactttaagttacactggataccgattactggagtatttcagtgaatgggggcgagctatggtagcgcagaaagccaaagtgacgatctttgacgtggcgaaggcctcaggtgtgtcgagcagtgcggtctcgtatgcgctcaatggcaagccgggtgtttccgatgccacgcgcgagaaggtgctgcaggtggcgcgcaaactcggctggcgtccgaacggcgcggcacagtcgctcgcgcagtcgcgcacgcgcagaatcggcctcgtgctcggctacgatccacagctgctttccgcggaaccctacatcatgcgcctcatctccggcctcggctccgcgctcgaggaacgcgactactcgctgctcgtgcgcatgtcgatggatgacgacgacgaggtctcgatcctcgaggactggatcgccaccggcaacgtcgacgcgctgctgctgctcaatctggagatcggcgacccgcgcatcgagctgatgaagaacaatccgcagatgccgtgcctcgcgctggcggattcgtcgctgacgagcggtctgcccacattgatgagcgacgacgccgcggcatcgggcacgatgatccggcacctcgccttgttcggccacaagaacatcgcgcgcgtggcgggaccggaggagctcggccactcgtacatccgcgacgccgcgttctcggagatcaccacggagctcggcatgcgctaccgctgcctgcacaccgactacacgccggaatctggcgccgaggccaccaagcgactgctcagcgtggaaccgcggccgaccgcgatcatctacgacaacgacgtgatggcgctggcgggggagagcgtcgcctcggtgaagggtgtgcgcgtgcccgaggatctttcgatcatctcgtggggcgattcattcatgaacgtcgccgcgcatccgccgatcaccgcgctcagccgcaacattctcgagtcgggacgtctcgccgcccagctcatgctcaagctcatcgatggcgaggacgtggagaacgtggaggagccgccatacgagctcatcgagcgcgcctccaccgcgcctgccgcgcagtgattccggtggcctcgccagcatcggtgtgtcacgttgctgctattacccggtaattatttcctacgggatgtcaccatctgctacgggatgtcatagtcaaacccatccgtgcgggtgcgatcctcagaaaatggctatattccaacaacccgttaatcgcagatgacatcccgtagcagatggtgacatcccgtaacagtttatgggctcctgtggcagatggtgacatcccgtagggaatatgcgggaatgtgtcgcatgaggagcgagtctgcggtgtgcgtcagtcctgtggctggaggtcgaaggcgcggcggatgagccacatctgtgcccaggcgctcgcgccgccgccaaagatgcaccagacgagcggtacccacatcaccgcgctcggcaatgtggcgagcagcacgatcggcagcgcgtagatcgcggcgacgacgagcgcgatgaacggcttcatcgtcgcgagcttggcggactgcttgatctgctcgccggcgctcagcttggaacggccggacagcggcagcaggaacgcgaacagcatcgccacaatgatgaacaccgccagcgtgacgccgtagagaacgctcgccatgtcgccggccatgctgcgcgagatccaccacaggtcgaaggcgccgagcgcaatgagcacgccgaggaacagcgtcagcagcatgccggtgccgaatctgcgtttgatcgcacgccagaagcccttgaaaatgccgttgtcgcggtcctcctgcatctcgcgcgccacttcgcaggccgccgcggtggacacaccgatcgtcacgaccggcagacagcatacgaaccacgccaccgagagcatggcgatgtctccgatgcggttcatcacggtgttgtacgggttgtcttgacggaagattcctccggctatcattctccttaaacgcttcatgtggcgggacgcgggagtcccggctggtttggcggcgtgggccgcgtgacgatgcttgctatgggttagttgtacaggtattggatgaagttcttggcggtgtcgagttgctgggtgttcgcggcgatgccgacgagtgcgtcgtcgtccgcgccttcgatgcggtcccagcgcggcgcatgctcgagcagcaggccgtacggctcggacttgccctgcccgctgcccgactcgtcgatcgcgtcggtcacgcgcgagtcgtcgaatccatggaacgccatggcgtatttgcccaccttcgcgtattccgcggcgggcagcgtggtcttgagattgtcgaagtacccgaagctcgccagtttcgcgaacacgtcgtgcggtgcgatgacgacgtcgatctgctcattgccgatcatcgtctgcaatttcgacagaccgtctttgttcatgtcgaaatagtcgtcgatgatcacgtctttgccgagtttcttcgcatagtcgtccttgagtttgtcggcctcgcccatcggcgtcgatccgctcaccgccgccgcatacagtgcgggacgcggtaccgggctgacgaggcgcacgatgacgaaggtgccgagcgcgatcacgatgacggcggcgagcagcggcaccaggaagtgcgtgcgggaatacgcggccttgtctttcgcgggaatcttcatgaagatcttgatcttcgattccccttggtactgcggcgtcgacgacaacgtgtcgattgcttcgcgctgctcgggcgtgagcttcggctgcttgccttccattcgtccgcctattagacctcatctcattctagtgagtgcgctgggtaaatgctgggcgcggacggtgttccctactgtgcggtcatgttcgaaaaatctgcgttttgttatggtctgcagattgtttccgccattttccgcggcttgtgtgcgacgtgcccatcttcggcgatcgaggcgcacgcagaccggtgttcgtttgcgtgacttaaccgcttaatatattatggaatcaaggaaaagtcaatgccctcaccaaagtgggtgagcggagaatcaggcaagaggggcaatacctatgtacgacgagggaccacatatcgtgctgcgtcgcgacggcgtgtgcatcgtcgcgaagacgccggacggcgacatgccgcagatcgaatactggggtcgtgattttgcgttcgacaccgccggggatgcgctgcgccagctcgacatgcgcgcaatctgatatctgattcgccggtgcgcggcggaatgcggggagcgcggccacactcacgtggtcgccctccccgcatatggaggtcgtgaaacctgacacacgataggcatttcgagcttgcgacttaagcgcttcagtgatacgctgtatacagaacgtttctgtcaacgacgatgcgagcggatcgcaggtcgcgaaccgggaaatctggaatctgaagacatgcgaagactcctcatccagattccggcacggcggcagaacagcaggatcgggccggtgcgtcacgcgcgggcccctcattggaaggcaagggcacatggccaacacagatccgaagtaccagatcggaacgccggagaacaagaagttcctcgacatctcccgcgacaatctcattgcattcggtcgtcgcttcccggcggtcgacggcagctcctactggctgggcgacgacggcaccccgtggaaggaccgcaaccgcgccacctggatcacctgccgcatgacgcacgtctactcgctggccacgctgctcggtgtggacggcgccgcggaactcgtcgacgacggcatccgcggtctgcgtggcgtgctgcacgacgaggagcacgacggctggtatgccgaaatcacgccggacatctgccatatgcccaccaagcaggcctacgcgcacgccttcgtgctgcttgcggcatcctccgcgctgctcgcgggccgcccgggcgccaaggaactgctcgaacaggccgagaacgtctacctcaccaagttctgggacgacaagatcggcctgagcgtcgacacctgggacaccgacttcgcggaactcgacacctaccgcggtctcaatgcgaacatgcactccgtcgaggcatgcctggccgtcgccgacgtcaccggcgacgaaagctggcgtacgcgcgccggccgcatcatcgagcatgtgctcaagtgggccgaggagaacaactggcgcattccggagcacttcaactccgactgggagccggagctcgaattcaacgccgacaagccggacgaccagttcaagccgtacggcgccaccccgggccacggcatcgaatgggcacgtctcatcacgcagtatgcgctgtcggtgtacggcaaggacggcgtgctgaacggtgacggcaagaagtacctcgacgcggcagagcacctgttcaaccgcgcggtcgaagacgcctggaacgccgacggcgcgccgggcatcgtgtacaccaccgactgggatggcaagccggttgtgcacgaccgcatgcactggacgctggccgaaggcgtgaacaccgccgccacgctctaccatgtgaccggcaagaaggagtatgccgactggtatgcgaccttcctcgagtacatcgacacctacctcatggatcacaagaacggttcctggttccaccagctcaaccgcgagaacgaagtcatcgacaccgtgtggccgggcaagtccgacctgtaccacgccacgcaggcgatgatgatcccgctgcgtgacccggccctgtccattgcgcccgccacgaagaagggcgtcgaggaaggcctcaactaagactttcagcaagccgccgtcaccagacttgtgtttccccttgcttggtaggtcacggtgatggcggtcggctgaaatagcaaggcgtcgcatttgcggcgctttttcttttgcgcgtagctgtctgccgaagaagaccgtggaatccgatctgcgtgtgagacgaactaagtaagcggcggaggaatcttctcgcatatagcgggcgtggagccatcgcgtgctgttcttcctgcgtaaaaagagtcagatggagccgccatactgaccctttttacgcagatagggcagatagggcagatagggtagatatcgcagatatgccggattccatttgcgtaaatcgggacaattcgacactgcatattgacccttttttacgcagagttgggggcatggcggcctgaggtgaggcggagttgagagcatgtcagtccgagtcgggcagggccgcgcggtttcacggagtctcgcacaggtcgccgtgtgtcttacgccataggcaacacgggggaggtctgcccataatgggaagcatgagttcagcgcacgatttccatgcgacgggtgtgaccgccgtcgtgaacaatgatgccggcggcacacgcacaatcttcaaggacctctcattcgcagtgcacggcggtgagatcgtcgacatcaccgggccgtcgggttccggcaaaagcacgctgctcacctcgttcgcgcgacttaacgtgaacacgaccggcaaattcgtgctcgacggcgtggattccgacacgctctcgccgcagcaatggcgcgagcgcgtggcctacctgccgcagacctccgtgctgatcggcgacaatgtggccgacgcgatccgcctaccgtggtcgttgaaaatccgcgtctcgcaggatcatgaggccgctgagcagaaactgcccgactcgctcatccgctccacgctcgactcgctgggctgcgacgacatcgatctggcgcgcgccgtgcaagatctctccggcggccaggcagcacgcgtttcactcactcgcacactgctcacgcatcccggcgtgctgctcgccgacgaggtggacgccgggctcgacgaggaaaacgccgacaaagtggccgatattctgcgcaaggcggcagacaacggcactgcggtcgtgcgtattcgccaccgcaagcccgacggccgcgcgaaccggatcatggtgctcgcgaacggcacgatctccccgctaaagaccgcgcaatccgcacccagcacgcacacggaggtctgacatgcagcaatacttcgccatagacaactggggtctgctcatcgcggtgctcatggtgtgcatcgccgccggagtctccgcgctgatgaaactcggcgtggccaagtcgctgctgtgggccaccgcccgctcgctcgtgcagctgctcgccatgggcttcatcctcgaatatgtgatccgcgcgcagaatgtgtggctggtgatcggcctcattgtggtcatgctcgtcgccgccgcgcagatcacgatgagccgcgccaaaggtataccgaaaggcctggtgccgctcgtgctgctgagtcttgccgtgacgatgctgctcatgctcgcgttggtgggcgaactggtgatccgcccgaacccgtggtattcgccgcagctgatcataccgctcaccggcatgctgctcggcaacacggtctccgcgctggcgctcggcctgagccgattcttcaattcgatgcgcgaacgctacgaagaggtgaacacgctgctcgcgcttggtgcgacgccgtgggaggccgccaagccgtcgatcacctcgtcgatcacgctcggcttgcttccgtcgatcgccatgctcgcctcaagtggcatcgtgacgatcccgggcatgatgtcaggccagatcatcgccggtcagaacccagtgaacgccgccaaataccagttcgtcatactggcggcggtctccgcgctcacgctgcttgcagattcgataatcctggcgctcgtctacaagcgctgcttcatttcgtacgaccgctatttcgtgccgccggcgcgtgactcggtgagcacactcgaccgcatacgcaggcaggcggcggagcgtgcgaacagaggtccggagtccgccggggagtaatctgatccatcggcaccgcaccggcatgatcatagatatacggctcgcgcgtagaatggcgataccgcagcaacgtgcgagcgcgcgtgcggcggcgcaggagagatgggagcgtccgcgtatgcacacgcgggctatgcaaaaggatgcctatgagtgcttcacatggtgcaggggagcggaacgccgacccgcagcaattgcataaatcgttgaaaaaccgccatattcagctcattgcgctgggcggtgccattggaaccggtctgttctacgggtcgagcgagtcgattgcgctcgccgggccgtccattctgcttgcctatgtgattggtggcgcggcgatcttcgtgattgtgcgcgcgatgagcgagatgagcgtggaggagccgaaggccggcgcgttcagctactatgcgtcgcggtactggtcgaagcgcgcggggttcatctcgggctggaactactggttcaactatgtgctcgtgtcgatggtggagctcgcggtggtcgggtccttcgtcaactactggttcccgaacattccgcagtgggcgtcggcggcgttcttcctcgtgctcatcacgctgctcaatctgttcggtgtgagcgagttcggcgaattcgagttctggttcgcgctcatcaagatcgtggccgtcatcgccatgatcgcgggcggactgtgggtgatcgtagcgaatctgcccaccgactccggcgtgcgcgcctcgttcgcgaactggttcactgtggacggcggcttcttcccgcacggcgccatgtcgcgcgcggccgacggccactgggacggcctgctcatggcgctcgtcgtcgtcatgttcagcttcggcggcaccgagctcatcggagtgaccgcaggcgaggtggagaacccgagcaagacgatcccgcgcgccacgaacggcataatctggcgcattctcgtgttttacgtggccgcactcggcatcatcatggccgtggtgccgtgggatcgcatcgacgggaagatgagccccttcgtgcagatcttcgattccgtgggcgtgccggtggccgccggaatcctcaatttcgtatgcctcaccgcagtgatgagcgtatacaactccgcactgtattcgaattcgcgcatgctgttctcgctcgcacgccaaggcaatgcgccggcatatctgggacgcgtgaacaagcgcggcgtgccggtggcgggcgtgctcacgagcgccgccgtgaccgtggtggccgtcgtggtcgtgttcctgtggccgcagttcgcgttcaattacctgatgtcgatcgccacgatcgccgcgattatcaattggacgatgatcatgatcaccgagatgctgttccggcggcgtgtggctgccggtgatggtccgggcgagctcaacggattgcgcggtgccgaggcgctcgcgaagattcggttcaagctgccggggtggaactggacgccgtatgtgattatcgcgttcctcgccatggtggccgtgctcatgtgcttctcgccgagctaccgcattgcgctcatcgccggtgtgatctggctcgccgtgttgttcgccgcgtatgcgatcacctcgcgcgcctcggcgaagcgcgacgcgaagaccgtgctcgactccacgcgcaagtaggcgttgccgtcggccgctgtgtggtcggttttgcggatgcttccgtatggcatgccgttttcagacttcttcgcggtcggttttgcggatgcttccgaaagctatgctgttttcagaccattccgtggcgcgtttctcggatacctccgagaggcatgccattttggagccttctggcagtacgtttctcggatgcttccgtacgctgtgctgcggggaagacggcctgcggtttggttctcggatgcttccgtgagatgtgcctctgatggggtggtttctggcccatctctcggatgcgtccgtatgctgtgccgctgcaggggtggtttgcggtccgttgtgcggatgcttccgtaggctgtgccattttagattcctttgtggcacgtttctcggatgcttccgaaagctgtgccgttggcggggtggttagtggcacatcccacggatgcttccgtatgttgcaccgcattggcgggcagcacgcgggggcggccactgtactccagattggttttcgcataatctatatatgtatgctgtgcgatgacgtgcaatttgtatagatggaggtggccatggcatacatcgagttcaatgatgtggtcaaggagtaccctgccggttcctcctccatccgcgcgctcgacggtgcgagcttcgccgccgacgaaggcgagctcagcgtgatccttggccagtccggcgccggcaagacgactgcgctgaatattctcggcggcatggataccgccacctcgggacgcgtgatcgtgggcggccgcgacatcaccgaccttaatcaccatgatctagtgacgtaccggcgcaacgacatcggcttcgtattccagttctataacctgattcctaatctgacggcgctcgagaatgtggagctcgcctcgcagatttgcacagaccacttcgacccggcgcagaccttggcgaaagtggggctcgcggatcgactcggcaatttcccggcgcagctgtctggcggcgagcagcagcgggtgtcgatcgcgcgcgcattggcgaagaaaccgaagctgctgctgtgcgacgaaccgaccggcgcgctcgactacgagaccggcaaggaggtgctgcaactgctgcaggacatctgccgtaccgagcgcatgaccgtgctcattgtgacgcacaactccgccctcgccccgatggcgcacaaggtgattcggttccgctccggcaaggtgacgagccaggagaccaacgaacacccggtgccgatctcgcagattgaatggtagggggggcgagatggcacggcgtaaaggtgttcccgttggcgatgccgatgtgcatgcgcagattgcagattccggctcgctgcatgccgaacatgggcatgcgcgcgcagtgggctcggcattcttgctcgatacgatgcgctccgggctgcatgcgtggaagccgttcctgtcgattctcatcatcacgatgctgggtgttgcggtgctcaccggcatctacgcaggctgccgcgacactttcgcggccgcgaaccggttctaccgtgcgcagggattgcacgatgtgcaggtaatttcgacgatggggctcaccgatgccgacgtggacgcgctgaggcaggtggaaggagtggagcaagcgcagggcatgcgcatgattcgggtgaaggtggcggatggcgacggcaagcagctgaacgccaccctcgaagagccggcaagtggctcgccagccgccttggacaggccctatgtgaacgaggggtggctgccgagcaagcccggtgaggtggcggtgaccgcgcagttcacgcacgacacccacaagaagctcggcgacacggtggaggtcgccgccgatggtgaggatgatggcacccatgggctgaagatcgtcggcatcgtcaccgacccctccgacctgacgaatccgggtggctattcgggatccgcattccgctcgtcagtgaccaacgactacacgttctacacggctccggacggcattcagcgcaccttcgtcaaggccgatggcacacccatcgccgccgccgacccgaaggtgtacggctcgatcgtgctccggctcgatgatgccgagaatgaggatgccttcacggccagttacgacgatcttgtgtcgggaacggtcaaacgcattgagaacggtgtgcaggccaagcgcgagcaggcccggcgcaacgccttggtggaggaggcccagaacaagctcgatgccgagaagaagaaggcgttcgaccagatcgatgcggcgcaggccaaactcgacgcccagcgccggcagctggacgaccagttgaagcaactcgacgcccagactgcgcagattccggtcggtgttccggagccggcccaactcgccgaggcgcagcgccaatgggcggccgccgacacgaaactgagggaggcgcagcaggccatagacacacagcggaatgaggcattcagcgcattcgccgccgaacagcagaaggtcgacggcatcgccacgccacgctggtacgtgcagtcgagatcggcgcttgccgggttcagctcgctcaaatccgacatcagctcgatcgagtcgctcggcaaggcgttcccgattgtgttcctcgtggtcgccgtgatgatgagcctgacgacgatgagccgtttggtcgaagaggaccgcgggctcgtcggaacctaccttggcttgggctacgggcgcatcgccatcaccttgcgctacgctctgttcgcgttgctggcatgcctcatcggcggcggattggggctgctcatcggcttcctcggcattcccgccttcctgctcgtggtgattcgcggactctacgcgattccagacttgcggctcgaatatgactggctctatggctcgcttggcgtgctgctgttcgtggtgggcgtgctcggagcggcactcattgcctcggtgcgcgagatgcgccagatgccggccgccctcatgcgaccgaaggcgccgaaggccggctcgcgtattctgctcgaacgtgtacgcccgctctggagccgcatgagcttcctgaacaaggtgacggcacgcaacatcttccggttcaaggcgcggctcatcatgacggtgggtggtgtggccggctgcaccgcgttgatcctgtgcggtctggccatcaacgacacggtggccgcactcgggcccaaccagtaccgtggcgtggaccaatacgacatgctcgccgtggccaacgacggcgacgaacaggcattgagaaagaaactcgtctccgacggtacaacgacggccatcatggagacgcgcatcgagaacggcgagatcaccaatgccaatgaccgaggcacgaatgttcagttgaccgtggtgccgcaacgccagctgggcgagctcaacacgatgttcgatctgcagccggcgcagggcgattccctgctcggctgggtgcatggcggcaaccgaaaccagccggtgcgcctcgacaacagcggcatcatcgtcgcccagtccgcggcacagtcgcttggcatcaaggcgggcagcgaggtcacattgcgtggcgacggcacccagccgcacaaggtcaaggtggcgcaggtcacccgcagcttgatcggcgcggaggcgttcatctccgaagacctctaccatcagctgttcccggcgcaacaggccggcgatggcggcacggaaccagcaatcacctggaacgccgtctacgccaagctcaaaggaagcgacagcgagcaaagcgaatacgtgcagcacctcaagaacgaggcgaccgtcatgagcgccacctcgtgcgcacagcaggccgaggatttcaaattcgacctcatgggcgcggtcgtggcgttgattgtcgcgctcgcgggcagcctcgcgctcgtcgtgctgttcacgctcgcgcacaccaacgtttcggaacggttgcgtgagatggccacactcaaggtgctcgggttctacggccgcgaggtgcaccattatgtgaaccgcgaaatgatggtgctcaccgtgatgggcatcgtcataggcctgccgctcggcagatgggtgtcgggcctgctcacgaacgcgctcaacatgcccggaatctacttcgaggtgcatatctcgtggtggagctacatcatcaccgttgtggccacgcttgcattcgcatggctcgtgcagctgttcgtcaatccggtgctcgaccgcatcgaccccgtcagctcgcttaagtccgtcgaatagtttgcggtgtgcgaacgcgatgtgcaacggatgcctgctagagtcggaaatattatgtcggatgtgcagcaaccagcggaacctcatgagacccctcacgaagaggaagtgaacgcctcgctcgagacgctcgacaaagacaacgagatggaacgtggcctgagcaatcgccacgtgcagttcatcgcgatcggcggtgcgataggcacgggcctgttcctcggctccggcaagtcgatcaatctggccggcccgaacatcattttcgtctacattctcgtgggcggcatcatgttcctcatgatgcgcgcgatcggcgaactgatgtaccgcgacccgagccagcacacgttcatcaacttcattcgcttctatctgggtgacggatggggcaagttcgcgctgtggtcgtactggatcgtgctcattctcataggcatgaccgagatcaccgccgtggggcagtactgcgtcacgttcttccgcacgcttgggtacgacgtctccgcgtggaaggggctcatagaactcgggttcctgctgctgctcgtcatgatcaatctcattgccgtcaaggcgttcggcgaggcggagttctggttttcgatgatcaagatcacgctgatcgtggccatgatcgccacggccgtgatcatgctcgtctgcggtttcaaatacaacgccgtgcaggtgcccgggcaggaccatgtgtcgccggccggcagtgtgacgctcgacaatctgacccgtggattctcgctcgcgccgaatggctggctggcgtttctgatgagcttccagatggtcttcttcgcctatgagatgatcgaattcatgggcgtcaccgtctccgagacgaagaacccgcgcaaggtgctgccgaaggcgatcaacggcatcatcgtgcgcgtgctcatcttctacgtgggcgcgttgctggcgatcatgacgattgtgccgtggcgcaacttccgcccgaacaaagacggctccttcgcctcgccgttcatcatggtgttcgaatacgcaggcgcgaactgggcggccgccctcgtgttcttcgtggtggtcacggccgccgcctcgtcactcaactcgctgctgtattcggctgggcgccatctgtatgagatcgccgaggattccccgtcgcctgcgattgcgaaactcggcgtcgtctcgaagacgaaggtgccggcgcgcgcgatcatcgcatcggcgatcctcgtgctgctctcgccggtcatcgagatgatcccgcgcgtctcgggcgctttcgtcatgttctcgtcggcgtcgtcggccgtgatcatcttcatttacatattgacgatgatcgcgcactaccgttaccgcaattcgccgcagttcatggctaacgggttccgcatgccggcgtaccgcgtgctcaacccgctcaccaccgcgttcttcgtgttcatctactgcacgctgttcattggggcagacacccgcggaccggcgatcgccggtttggtgtggctcgtggtgttcggtggctactgcgtgctgcatgagcgcttccagaaccgcgatctcaagcagtccatagattccgcgggcgatgcgcacgcgtagcacgcggctgatcagtcgctggccaccgcttcgagcaccggtttcttgagtgcgcggcttgccggcgagatgctggcgatcaaccccacgagaatggccgcgccgaggaagccgagcagttgcagccatgggatgctcatggtggaaagaccgttgtcccgatacgcctggcgaaccaccacgccggcgccgagccccacgaggatgccgagcacggtgccgaacaccgagagaatcaccgattctatggcgatcatgccacgtacctgcccgttcgatgtaccgacacctgctcgcccacttgctgttcatatgccgcgatggcctgcttggtggccgcttcgtcgatgccgatgttcttggactccatttccacggtgctgccgattgcatacccgttggagtctgcgaccttgcgtccgacggcgatctcgccatgctcgatggcctgcgctgcatcgccttcctgatgggtggccgggtacatggcatcgaggagttcgcggtccaccgccatggcggtgaattgctcgttcgcctgcatgagcttgacggtgggcagtgtgcgcaccgccgttgttgcgccgactccggccgtgtgcttcacgtcattgacggccttcggcgagacggattgcgagagcgcggcggagacgagcacatagtcggcatgaagattgtcgtcgatcatatcgctcaccgaggcgagcattgacgaggcgagcacgctcaggcaactgacgattgccacgcccacgaacagggcggcggccgtgttggcggtgcgacgtttcgtgcggccgatgttgcgggtggccagcgtgccggtcaccgggaatgcgagaggggagccaccccagcaccttggcggcgcctgtcaccagagccggggcgagcacgatcacgccacccgccgtgcatacgccgcccaagccgagcagccaacccgtgcccaccgtggtgagccatgcccatgagactttcttggctgccagcagccagcacaacaaccagcacagtgctccgaacgccaccatgccggcaccgatccaaccgcgtgccgtcaccggcttctcggggttcatcgtctcgttcatcgcctggatgggtggtgccgtggcggcggtgcgcgcgggaatggcggagccgatgaccgtgaccaccacgcccaccatgaagccgacggcgactgccgtaggcgaaggcgttggagaaccggacagcgggaagccgcccttgctcaggccccagtcgatgagctctatgagcccccagccgaggagcacgcccagcaccgagccgatgacgccaagaatgagcgcctgaatgaccacgctgaagaacacctgtgcaggggaggccccgaccgagcgcagcagcgcatagccgcgcatggaatcacgcacgatcatcgtgaacgtgttcgcaatgatgaacgcgccgacgaagagggcgatcactgcgaagatgagaatgagcggctggacgaagccgagtgactcctgcgtgcttttcgtggcctcgtcgcgcaccgactggccggtgaccgcatgggccttggaatccttgggcagcgccttgttgatgcggtccgcgagctggtgttgcttctgaaccgtgagtggggtggtgcggttgccgtatacgccgatcttgtctactttggaggtgtcttcgccctgcaactgcatgagctgattgaccagcgccggctgtgcgagaatgatcagcacgccgagttcggcggtctgtgtggtgaagacgcccgacaccttcatggtgtgcggctctccgttgacgatgagccgcgtggtgtcgccgacctggagtcccgccttcttcgcggcgtcctgggaaagggcgatctcatgctcgccggtggcataggtgccggcgatgaaattggcggcgcgccaagggtgttcggatgatgcgctgatcatgagcgttggcgcgccggtggtgaccactgcattgccgtcatggtcgagcagcgtggcacctatcgtgcgttcgggcgggcttacgttgtcgatgcccttgacctgctcgatctgggtgacgaggctcgtatcgatcttgttgtagctcgtgccgcttgagatcggcccgctggtggcgaaggagctgtcgttctgttcttcggtggtgccgcgcacatacacgtcgtgatccgaattggtgcccatcagctgcgtcacctggtcgttcagcatggaacggaagcagaacgaaccgaccacgaacgagactcccaatgcaatcgcgatgatcgacatcacgaggcggtgaaaatgcgctttggcatcgcgtagaccaatgcgaatcattgttccgcgctccttgccgttgcagactccacctccaccggaccgttctgcgggtcgtcgtcctgcgcgaacaccgcgagaatgtcgtcgtacgacggatggtcgaggtcctgcacaatgctgccgtccgacagtacgagcacgcggtcggcgaacgacgcggcacgcgggtcgtgcgtcaccatcacgatcgtctgcccgtattcgcgcacgcacatgcgcaggaattcaaacacctcatggctcgaccgcgaatcgaggttgccggtcggttcgtcggcgaagatcacgctcggccgctccatgatcgcccgcgcacaggcgacgcgctgctgttggccgccggacagctggctcgggcgatggtcgagacggttctgcaacttgaccaccgacaccactttgtcgaaccaatccatatcgatgggacggtgggcaatctgcagtggcagcagtatgttctccttcgcggtgggcgtgggaaccagattgaacgactggaagataatccgatctccttgcgacgcagctgcgtgagctcgcgttggcccattgaggagacctcgaggtcttcaatgaacacctggccgctggtggggtgtcaagcccggccatgcagtgcatgagcgtcgatttgccggaacccgagggacccatgatcgccgtcagggctttgcgcctgaactccacgttgacgtggtcgagggcgatgacgctgttgtctcctttgccatagcgtttgcacagatcgaccgcacgggcgacgatcggattccgtccttcactgttcgatgcggtttgcgtgcccatagaagccttccctgaaacaacacgtgaatgttatgacttaagactcgccacagaagaataccgaacccattttttcagtattggcggttatatttcagcgaaatttgacaaacggtgaaaacatgctaaaagcttacctgcaattcgttgtcgtgggagtgtggcctcatgccgagcccggaggcgtgtcaccgcgctctcctcgattccctgaccgttcctcttgatccttgaatgaaatttgtcttctactgtaagtaacttaccctgtaagacaaattgtgttttgcgtatggagcggctatggattaccaactggaggcggtgcacgaactgatgttcgcgatgtgggcgtcacgctcgaaggcgacgcgttcattcgagcgcggtgcgcagggcgagatgttcgtgctccgcgagctctcgttccaaggcgcgcgtacgccgtcgcagctcgcccaggcgatgggcgcgacgagtgggcgcatctcgtcgattctggccagtctcacgaagaagggctggattgtgcgcacgggtgatccgcaggaccgccggagcgtggttgtcgagctgtccgacgagggaagacgtgctgtgcgtcagcgcagcgaccgtctcattgagaacctgtcgtgggtcttctcgcagatgggagagcgccgcacgcgcgaattcgtgggcctgctctccgaattcatgacctacttgtcgatctgcgagccggatggctcttaccccaccgtcgaacaggtcgaggaggcgttcgaacgtcgcgcccgactccacgaacgtatgcgcgagatggtgcgcaatggcgagcaatggcatggctcgtgcaggccgcatgatgcgccgtcgtcgaacgacgccgacgtcgaccgtcccgtgcaataaggacgccgtgcgcagctccagaatccgcacatcatctgtttgagaaaaaagcttacggtgtaaggaaaaatatgatacgaatcatgaaatatctctccaaaacggagatagggcagctggtgttgtcgctggtcaccattgtgggccaggtgtacttcgacctcgaactgccaagctatatgtcacagatcacgcggctcgtggagacgccgggcagccagatgcgcgacatctggatcgccggcggcaagatgctgctcgtctcgctcggctcgctcgcatgcgcggtgatcaccggctacttcgccgcgcgcgtggcggcatcgttcggccagcgtctgcgctcgctcgagttccgcaaggtggagtcgttcgggccgtccgaaatgcaccgcttctccacggcgagcctgatcacacgttcgacgaacgacatcacgcagattcagatgttcatcacgatgggcttgcagatgctcatcaaggcgccgatcatggccgtctgggccgtgtgcaagatcgccggcgaaggcttcgaatggacgctcgccaccggcatcgctgtggcgatcctcatcatctcgatcgccgtgctcatggtgctcgtcatgccgaagttcaaggcaatgcagcagctcaccgacgacatcaatctggtgacgcgcgagaatctgaccggcatgcgcgtcgtgcgcgcctacaatgcccaggactaccaggaaggcaagttcgagcgggcgaacagcaatctgacgaacacacagctgttcacgaaccgcgcgatgtcggtgatgatgccgctcatgggcacgatcatgaacgggctgtcgctcgcaatctactggatcggcgcctacctgatccaagacgccggcctgaccgacaaactcacgttgttctcgaacatggtcgtgttctccagctacgccatgcaggtggtgatgagcttcctgctcatgagcatggtgttcgtgctgtggccgcgcgccgacgtctccgcacaccgcgtgctcgaagtgctcgacaccgacccgctcgtcaagtccggcaccgcggagcgcgggctcacggtgcaggaggccaagcagcgcggaatcatcacgccagcggaacgtgcgcgatatgccgacgacctcgagctcgccggcgagatcgaattccgcgacgtgagcttcacctaccccgattcgcgcgaggcgatgctcgaacacatcagtttcacggcgaacaggggagacacggtggcgatcatcggctccaccggttcgggcaagtcgtcgctcatcaatctcgtgccgcgcttctacgatgcgacggacggcgaggtgctcgtggacggcgtgaatgtgcgcgaatacgacttgaagacactgcgcgacaagatcggctacgtgccgcagcgctccttcctgttcaaaggcaccgtcgaatcgaatgtgagctacggtgaccggcccgacgaacccgaggacgtgccagtgatcgacgtctcgcgcatgagcggccgcaaggcggaacgggagttcctcaaggccggcgaggcgcgcgagctcaccgcgcaggaggcgaaccgcgtgcgcgaggcgagcgacatcgcacaggccaccgaattcgtaagcaagatgccgaaaggcttccagtcgccgatcgcccagggtggcacgaatgtgtcgggcggccagaaacagcgcctgtcgattgcgcgcgccgtgtaccgcgacccggagattctgatcttcgacgattcgttctcggcactcgacttcaaaaccgaccgcgaggtgcgcgacgcgttgaaggagacggcgaaggacgcgacgaagctcattgtggcgcagcgcgtcggcacgatcatggacgcggactgcattctcgtgctcgaggacggcaaggtggtgggtcaaggcacgcaccgcgaactgctcgagacctgcgaggtgtaccaggagatcgcgaaatcgcagctgagcgaggaggagctcagtgcgtgagtggggcggcgaatgccgtatgcacatgtatgggtttgagatagataggatgtgaggatatgccaggaccaatgggacatgggcgtgcaggcgcgcccgtggagaaagccgatgatttcggcggcgcgctcaaggaactgatgcgcttcagcaagcgctacataccggcgatcgtcatcgcgctgatcctcggcgtcggcggcgcgatctgccagatcatagggccggactacctcggcgatatgaccgacgaaatcaccaagggactgcctgcgctcgtgcacggcaagccggtgctgcgttcgatcgacatgaccgcggtgacgcgcatcggatggacgctcgtggcgctctacgtgggctacgcactgctctcatacgtgcagagctggatgatggccaccgtcacgcagcgcacggcgcaacgcctgcgcgcggccatcgacgtgaagatgaacaagctgccgctcaaatacttcgacgagcacagcaccggcgacgtgatgagccgcatcacgaacgacgtggacgcggtgggccagacgctcgggcagtccctcggcacgctcatctcgtcggtcacgctgttcgtgggctcgctcgtcatgatgttcgcgaacaactggatcctggcattgtgcgcagtgggcgcgaccctgctcggcatggtgctcatgctcgtcgtgatgaggttctcgcagaagtacttcgtcaagcagcagatggcgctcggcgacgtgaacggccatgtggaggagatgtacagcgggcacaccgtggtcaaggccttcggcggcgaggccgatgcgatccgcagattcgaacgctacaacaacgacctgtacgactcgggatggaagagccagttcatctcgggcctcatgatgccaatgatgaacctcgtgggcaacctcggctacgtcgtcgtgtgcgtggtcggcgcggcgctcgcgatgaacggctcgatcgaattcggcgtgatcgtggcgttcatgctctacattcgcctgttcacgcaaccgctctcgcagttcgcgcaggcgttccagaatctgcaacgctgcgccgcgggctccgaacgggtgttcaccttcctcgacgaacccgagctcgccgacgagtccgacaagcagccattgctcggctacggcagcaacggcgagatcacgcccgtcgaaggccgcgtgagcttcgagcacgtgaaattcgggtacgagccgaacaagctcgtcatccacgatttctcggcggacgtggagcctgggcagaaagtggcgatcgtggggcccaccggcgcgggcaagacgacgatggtgaatctgctcatgcgattctacgagatcgccggcgggaagatctcgatcgacggcatcgacacgaagagcgtgccgcgttggaacgtgcacgaccagttctcgatggtgctgcaggacacctgggtgttcaacggcaccgtgcgcgagaacgtggcgtatgcgaaggaagacgtgaccgacgagcaggtggtcgccgcctgccgtgccgtgggactcgaccgttacatccgctcgctgccaaacggctacgacaccgtgctcgacgagtcggccacgttgtcgcaggggcagaagcagctgctgacgatcgcgcgcgccatggtgcaggattcgccgatcctcattctcgacgaggcgacgagctcggtcgatacgcgcaccgaggagctcatccagacggcgatggacaagctcaccgaagggcgcacgtcgttcgtcatcgcacaccggctctccacgattcgcgacgccgacatgatcctcgtcatgcgcgacggcgacatcgtcgagcgtggcacacacgaggaactgctcgcgaagcacggtttctacgccgacatctacaacgcgcagttcacactcgcgcagtagactgcatctgggctcactgggtgacctctacaccgtcggacggtgcgctgtcctgcgcggtgtcgcctcgcgcatagaacacggtgcccggttcgagttcgccatcgagcagcgtggagacggtgaccggcgtgaatccgcgttcgcgcaggccgctcacaatctgcgggatcgcttcgactgtgcgctcgttgccgtcgtgcagcgcaatgatcgcgcccgacgatgcgccatcgagcacggttttggcgatgtcggcggcggatgcctgcgcgtcccagtcgcgtgagtcgacgttccacagaatcaccgactgcccgctgcgtttcgcggcgtcgacgacatcttcgctccacgcgccgtccggcggtcggaacagcgtcggcttgcccgcgcccgcgctttcgatcacgtcatcggtgtcgttgaaccatttggtgagttcggcgggggagagcgtgtgcaactgcttgtgtcgccagctcatcgagccgatttcgttgccctgcgcggccatattcgcgagcagttgtgtgttgctgccggagacaaactggccctgcacgaagaacgtggccggcgcatccgcctgcttgagcgcggcgagcagctgcggggtgatctgcttgtttgggccgtcgtcgaaggtgagggccacgcaggcggcgaattcgcagtcgagcggcatcgcgttgatcaccgcgttcgtggcgtcggtgagtgagccgagcgcatcgttgacctgcggattcgtagccgtggagcccggttcgagcagtgcgcccgcgttggcgatctgcgcctgcaatgcggcgcgcagattctcggccgccttgttcgccgagcgttcgtatgcggccttcgcaatggtgagctgcttctgcagttcgccgcgccggttcgagttgcgcgcgccctccacgagtcggcgcagcgtgtcggcgtcggtctgcacgtcgcgcatgcggttgaccatgctcgtgctcgcggcgccgaatctgcgggtgagctcgttgaggtcgtcggtgctttgcctggtgtcgcattcggatttcacgagcgaggagaccgtatgcgtgtcgtcgatgtgctcgattttgcttgccagcgcggtcgcatgatcctcgctgatcgttttgccgtcgcctttcgcgagcttgccggcgttggcaagcgtgaccgtgtacgtggtgttgagcgtggcgaattcccgttgcgcggattcgcagtcggcgagcgcggcggagtgctcctcctcggcatgccggtggttggcgcggctgattggaatgatgatcgcggcaagcacgccgacaatgatgagcgcagtcactgcaatggcgatgacggcgttgcggcgtttgcggggcgcggttggttcgtatgcagcggaatccgcggcggagccagttgcggtgtctgcgaattcggcgtgcatggtgtcgaaatcgtcggcatgcgcggtgctgtgttgtgtggtgccatgctgtgccgcgtcatgtggtgtgtcattgccctgcccggaagatttgccgcccatgttcgccccgttctccggcgttgtgcagtctgttctgccgttgctagtgtaccttgcggaggcaacggaggcaacggaggcaacggaggcaagcggatgcgctggtgtttttgtcaatctgcgcgggaaaacgcgacgatatgacgaaatctggtcatcagtttcgtcattggctcgcaaaaagccgcgcagatgacgaaacccgggtgctggtttcgtcattgttgcagattcgcgcggcgcaatgacgaaaacggcgcccggcagagtgtgcgatagccgagcggatggcgcgcttgcagataatggcgcgactgcagatagccgagccgcggcggccaatctgcaatcgacttcaatcgcagatgtgcggctcagcgtttcgttggggatgcagccggagacgcgcgtttgagcagcgtgcgcttcatcgccggcacatagaacagtgtgagccaggcgattgcgaacaggaggcccgcgcacacgtcgctcgcgtaatgcacgcccaaatagaccctggtgaacatgacgaccggcgggatcaggcacagcagcacgattgcgacgatcttccccacgcgggcgcccgaatcgcgcgcggtgtgccagtagcggtacagcaggtagacgatgaatccgtagaacgccgtgctcaccatcgcgtggccggaagggaaactgtacccctgctcgaacacgagatgcgggaaatccgggcgtggacggcgcacaatgtgtttgatgatctcgttgagcacataaatgcccgcgagattgacggccacagccacaccgattttccagcgcttcaccacggccagcacggcgagcgcgaccgccgccacgacgatcacggtgatcgacccggaaagctgggtgagcatgcgcatcacgctggtcatgccgggggtcatcacatgcgcggtgatccagccgtatactgcggtgtccatgccgagtatgtggaaccggcacaccgcgatcgtgaaccacagcgcgccgatcaggctcagcgcgccgataatctgccaacaatgtttcctcacgaacagcgaatccatagtgccagactagcgggcagcccaatacaatggtgtcgacgacaacgatgtacgaaagacgtgtcaggagagcaaatgagcgacatggaagaccgcatgcacaccggcgagatgtacctgcctcacgatgagcagattctcgcgcgccagttcgactgccttgagcggctctacgatttcaaccagacgcgcccgcacgagctcgaccgccgtgccgaactgctgcacgacatgttcgccgagatcggcgacgcctgctacatcgaaccgccgttccacgcgaatttcggcggggcgcacgtgcacttcggcagcgacatctacgtgaacttcaatctgacctgcgtggacgatacgcatatctatgtcggctcgcacacgatgatcgggccgaacgtgacgctcgcgaccgccgggcacccgattctgcccgaactgcgcgagcgcggctaccagtacaacatgccggtgcgcatcggcgagaactgctggatcggcgcgggcgtggtcgtgctgccgggcgtgacgatcggcgacaacgtggtggtgggtgcgggcagcattgtgacgcgcgacctgccgtcgaacgtcgtcgccgtgggcaatccgtgccatgtgctgcgcgaagtgggcgagcgcgaccgcgaatactatttcaaagatcgccggatcgactggaatgagatgcgcgccgacgaagccgcccactgacgctacaatatgggcgaatatgtgcgccgcgccgccgattgcgtcgcggtgtttggcgttcggcaagcggaagtgaagtgaggtgttggcatgcgcgcgctgaggcggttctaccggcgcaaccgaacattggtgacgtgggcggtgctgtgcgcggcgtcgatggcattggtgggccatgtgacctggctgccgggcgcggactcgctgttcaccccggtgagcggcgtgagcagtttcgtgctgagtccggcggcgggcggcgcgctgctgtggcggcagcgttcgcggcgcgcaatccgctggtatgtggtcgccgtgctgctcggcgccagcatgccgatgctgtggggatatttccgcaacgagtgggcgaatctgcaaatgcccacgacgcttgacggtgtggtcgccacggtttcgtcgctcgctccggcgattctgttcgcgctcggcgcgttctgcgtgtaccggtatgcgctcggcgggcgtcgacgccggcgttggtagcgtgcgtttggcgcgggcgcggggcgggtggtgcgtgcgtctgtcgccgacgctggttttggtgacgcgtgcgtttgttgccgatgccagcgctcgcgttggtggcgcgtgtgtctatgaggtcatggttgcaaaaggggcatgtcacagtgttctggagtgcctgctcgggattgaagttgcaaaaggggcacgtctgtgcgctccaggatggctcgctttgcagtcccggcctcacgtgagcatattcaggcatcttagatagtcaatctgagattatgcctgcaaaggcggcacgtggatccgcttgttatgtgctgctctgagattggtattgcaagggtggcacgttggtgtgctgcatgcgtgctgtgttgagattgaaactgcaagggtggcatgatgacgcgttctgcgtgtgctgtgttgagggtggtattgcaaggaagaccattttctctgcgtcttcgctgctcgtgctgccagtgcgatggcctatgatctgcaagcaagagaaaaggccggcggttcgtgtgccgccggccttccagagagaagagaagaagaaagaaggggtcagctcttgagctgatgcctatattgtagacttgcaatgcttgaggctaatatagagcatcctgagagtttgctgtgaaattgagccaggtcgatttcctgcgctgtttcgcagatgcgcggcatattgcgtgggtttttcgtaatccatgtcgtttgcagaccccgccgcggtccggtgcgcggacgcttccgaagacccggccgcaagcgggtgctttcttggctcctttttcggaagactccgtgaaacatgccgtgaaactgcggttctgcggtctgctatgcggaagcgtccgtgagattgaccgcgtagggagcagtttatggtcggttgtgcggaaggttccgtaaaacaaaccgcagatttcagcgtatgcgcaggcccgatcagcttgccgggcgcgacgcgaactaattctgcggcactgcgccctcctgtgaatccaagaagaccggcacattgctgtcgtcatactcatagatgccaatcgatgcggtgctcgggtcgtgggcgttgttgaagacgccgattgaggtcttgcccacgtactgaatttccttgccgctcttcatcagggccacgcagtcttcgtaagattcgcatttctcgcctttggtggtacccgaaacggccatgaggttcttctgcaccgtctcgctgtcggccgcgccgcctttctccgcggccaatgcggcaaggaccatggcgtcgtaggtctcggtgttataggtgtagatcgtcgtgtcgggcgcgatggtcttgagcgcgttctggaactcggaggtggggtgtgcgccgggaatcgtccccttcgaacccttgagcagcccgctggtgaaatccttcgagtggtcgaccatattgctgtcgggcatatagagcttatgggtgtcgatgcccttggccgccagttccttgacgagcgggatcgtctggtccgccgctatgaccagcacggcgtccggattcgtcgccttgatgttcgtggcgatggatgagaagttgttctcggccgggtcgaaggtctccgtctcgccgtacacgacgttcaccccgccttctttcaaggttttgagcacttctgcgcgcaatgagattccgtactcgtcgttgaacaccgcgatggcaagatttttgatgccgtcctgtgcgatgagatctcccatgacgactccttgcacggtgtccggcgggatcgtgcggaagaagtagtcgtcgagtccggagaacgccgtggatgtggcgcctggcgaaatcatagggattttcgacgtcgtcacttgcttataggtgttcttgacgaccgagctcaacggcgggccaatgacgaccgacgggttcttcgaaagtaccgactgcactgctgttgcgttctggtccgcatgctccgcgtccgaggtgtcggccgtgatggtgctgatcttgttgccgagcactccgcccgcttcgtcaatgtcctgctcggcgagcttcatggtagagacgttcgaggggcccagatatgccgcggttccggtgagcgggaacagaccgcccgcaacgaaggtgtcttccgccgcatttgccgagctgtcggctgttcccgtgccgcatcccgacaatgtgagcactgccgtcgccgccattgcggtggccgtggtgcgccatgtctttcgattgggcttgttcatttgaatcgccgtttcctctcttgcttggacccgaatgcctttcgtcccctgattgaaggtgtggtgcgagtcaagctggtgtgattcacgttcgcgaattgcaacggacggtgctgtgaccgccattcgatcatacgatcggtgagcgcatgggcagatctgccatagaatttttagttatacgattgtctatttatatatgcaattctgtgaatctgcagagtagattatctgccgctcgttacgagatgttcgcagaacgttaatggttggtaaatggtttatctttttataaaaatgcggaagtaattttgctgtattgatatttttagagaatagtgtgcagattgatgccgcttctgtattggatgcaaattccgcgtcgtcgtctgcggtggttttctgaggattttgcggcctcggtcatggggagattgctttgcggtctgttatgcggaagattccaagaggatgaccgcggagatggcaatctgcggcatgttgcgcggatggttccgtaagcagtgccgcggcgggggcgattggcggtcggttatgcggcagattccgtgggatggactgcgcaatggtcatcgggcagcgagcgtgggccacagcagggaggccatgtcgtgcgcccaggtgtcgtgggaggaatctgaaagcgctttggcggccatcatcgatccgatgaccgtctggaacaggaacggcacgctcacatctccgcggaatgcgccagaggagaccccgcgaccaatgaaatcggcgaagcgctgctgggcgggcgtgaccactcgctcggcgaggttcgcgaggtagtcgttgctcgacgacagcacgacgccgatcgccttgagtccaagttcctcgtcgaaacagtcgacaatgcatttgagcacaccgcgcaacccgtcgaacgtggtgtcgaatccgctgaaatcgagcggctcgcccacggcgaccgagaggtggcgcagcaggtcgtcggtgttcgcgtaccggcggtagatcgtggtcttcgccacgccggaccttttggccacggcctcgatggagaccgcgccaatgcctttcgcgagaatgagctcgagcacggcgcgcgtgatcttgccgtcggtgcgctcgcggcgcagcccatgccgcggaatgccaagcgccgggcggggggcgcgggcgcgagcggaggaagcagcgcgcgcggcggaagcagaagcggaggaagcggaggaaatggaatgcatggcgtcacctcatcccaacagcttggtgcgctcgaccctggcttcataccaatggttgaagccgagcagggcgtggcgcagcaccaggccaatgaacagcagcggcacgaggaacagggcgagtttgcccatggcgatccagtagtcgttttcgtagatgccggcgatggccccacgcatcgcggtgaccgaatagctcactggcagccatgggcttatatcgctgatgaaatgcggcagaatcgagagcgggtaggccgcgttcgaaccggagatctgcatgacgaggaacagcacgcctatcgccttgcccacgttcgcgaacgtggagacgagcgtgtacgtgaagaacgagtacacgatggagctgaaccaccccaccaacatgaagagccatgggtgcaccacctgcacgcgtaggaagagcagggtgcccgcgcaggagaatgtgctctgcagcagcgcgatcgagacgaacaccccgtagtggccgaggaagatctgccatggtttcgggttgccgagttcgcgctggcgtttgcgtgagatgccgatcttcaaggtgaccaccagcagcagcgcgcccacccatagcggaaggaacgtgtagaacggcgtgagcgcggcgccgaacgtgtcgaccgggaacagggcgacgcgcttgagctccaccggcgtgctcagtgcggtgctcagcgtggcggtgttgccgctgaggagctttttgatggtgcccatgttgccggtgtcgagtgccttggcgaactgggtgttgaagttcgtgagctccttcgcggcgtcggtgagctgggtggccgcgttgtcgatgagctcgtgcaccgagtcgagctgtttgttcgcgtcgctggccgtgcccgataggctgtcgagtgaggagtcgagcgtgctgacggtgccgttgagcgagttcgccgcgtcagagaacgcgttcgtcatcgcggtgaggtcgggcttgatcgtctcgtcgaagtccttggagatcgacgagaccgacgattgcgccttgcctgcgagatccttgatttcctgccgggtctccttgctggagccgaccttggagtcgacgtcgttcgcggctgtggtgagacggtctgcagtctggttgaggtcgtcggccaccgcgccgatccggttgatgaacgcctgcacggcggatttcgccaccggtcccagattgtcggatttgtcgagcagttcctgcagtctgccgcgcgtggtcgcgtacgccgtcgcctcggtgcgcacgttgccggcgaggttgttgattgccgcagacgtgtcgccggcctgcttgtcgaccgccgagaacagctcgtccacacggtcgttcagactgcccaaactcgttttcgaggtgtcgatcgccgtgccgagcgcattcaccgacgtgccgagcgcgccggagaggtcgctcacgccggttttggcggcggagagatcgtcgactcccgttttcgcggatgcgcgcgcgtcggcgatgagcttgttcgagctggcgagcagcgttttcgcggagtcggtgagcgacgagtatgtgcgcagtaccgccgcgctgtcgttcagcatgcccgcgaggtcggctatgttgccgttgaacgacttgagccgctgctggtattcgggcttgtcgagcatgtcgagcatggacgaggccagattcaatgcggtgtcggtgagcgttttcgagaacgtctggttgatcgtggcggcgatggtgtcggcgccctggccggtcaccttcggggcgagcgcgttgagtttctcgttgttgtagtagtcgagcgtggcgtggtacgcgtcatcggtgaagaacgtcatcatgttcttcgagaagttcttcggaatcaccacggcggcgtagtatttgcccgatttcgtgccgtcgatcgcctccgcgctcgatttcgtgaacgtccagtcgagctgcgagttcgcgcgcagcgtgtccaccacctgctcgccgatgttgatgcgcatgggcagcaggtcgcccttgtacccctcgtcgtcgttcgcgatggcgaactgcaggttcttcgtgtttgcgaacggatcccagcaggccgccacgttgaaccaggtgaacaggccggggatcacgatcaggccgatcgtgatgatgatcgagacgatgttgctggtgaggtgccgcacgtcatcggcgaagatcttcgcgagcatgctcatgccgagtgcctcccgtcgtggtggttgcgccggcttgtgctcccgcggtgcttcctctgccgttccggtttgcgcagttcgttgagattgaggtcgagcgtatcttcccgatggttcagatcgcgctcctcgcgcctcttctcggcgcgttcgcggctgttgctcgccgcgtccggcctgagctcgtccgccggcacggtgatgtggtgccggttgttgccgaacacgccctgcgccatgatcatgtcacgcaacgaatcctcgctcagcgagccaagctcggtctgccggcgcagcgattcgcggatcgactcgaccgtcatcaggaagatgatgatgatcagaatccacgcgatccatgtggcgagcgccacgagcttcgagccgtcggaggcgccgacgaacgagaaaacgatgaacaggacgatcggcaccgcgaaaccggccacgagcgcgccgcgcatcagccgcgggtagagtgtggcgaaacgcttggcgcggcgttcgatgcgcctgcggtattcaccgtgatcggcgagcacatggagcgcctgcgcgaggtcgaagcggttggcgggcatgtacacgcgctcgccgacgatcatgtcgccctcatgcacctcgcgggcgaacaggtggttgaaattgccgagccaggggcgcaccacgagtcccacgaagaacgcgatggccgtgaacaaggcgagcatgagcatcttcgtcagccagtcgccgtcgtagaatccggcgatcgtctcgcggaacgcgttgatcgagtaggtgaacgggaagaacgggtagagcgcgcggtagaagtccggcatcatctcgatggggtagaggccggaggcgccgggaatctgcagcatgacgagcgcgacaacgagcgccttgcccacatgcatgaacgtggcggacagcgcgtaggcgatggccaggtaagcgagcgaggtgagccatgccgtgagtatgaagacgaaccggttcgcgcattgcacgcgtatgatgaggtcgcccaccgcgcatacgatgccctgcagtccggcgacgatcgccagcagtaggtagcgtgccatgtaggtctggttcgtcgtcacatggcgtccttcaaggccttcgttgtccacttcgagcttgaacagcaccatgagcatgaacacgcccacccatagcgccagactcgtgaacagcggcgccatgccggatccgtacgtgtcgatcgggtagagcgtatgcgtgtcgagcacggtgggtgagagcatgaacgaggcgatccgcgaggcgtcgagtgtgccgttcttgctgccgagcaggtccgagagcacgttcgtgttctcgagcgtcttcagatcggtggtcacggtgtcgatgcgtgtgatgaacttgccgagcaggtcgtcggtgctgttgagcgagctggaggtggattggcagatctgcgtgagctggtcgaggatcaggttcgtctgcccggtgagcgactgtgtgccggtgaggaagccggagagcgtgcctgcggtgcccgaaagcgtggcgagtccggaattgagctgcggtatcgcgctcgaattgatcgtgttgcgtgcgccggagagcgcgtcgaccgtggtcgttgacgtcgcggagaactggtcgaccgtgccgagcgtgctgttcgcggctgcggtggtggagtcgttgagggtggtgagcgtctgcagtgtttgcgcgaccttttcgttctcggcgctcaggtcggtgacgatctcgttgatctgctcgctcagcgggttgtcggggagcgctttgaggtcagcgaggatctgcgcgttcgtcttgttcacgctggtgagttcgttgagtgcgctgccggtggccccgcttgcggtgagcacgccgttggcgacacgggtggccgatgtgctcgccttgccgctcgcctgcaggaacagattgccgccttggtcgagttcggtggacaggtcgttgctgaacgaggtgataccgccctgcgttttcgtgagcaggccggatgcgctggtgagtccttgggaggcgcttgtggcggccgagtcgacgccggcgagcgcctgtttggcggccgtggtcttctcgtccacgccgtcgagtgtcttgcgcagatcggcgatcatcgtgcgcgatttgctcagattggccttcgtggcgtcgagcttcgccacggtctgcgccacggtggcgttgccctcctgtgtgatctgcacattcgttgtgttgatcgtgtcggtgaccgccttgctcacggtggagacgaaggcgctgttcacttggcggtccacggtgttcgcgccgacgtcggtcattttcggcgcgacggcgttcactttctcgttcacgtagtattcgagcgtggggcgttggccgctgccggtgatcacggcggccatgttctcgctgaagttgcgcgggatcacgatggcggcgtagcaatgcccggattccacgcattccatggccttcgccttgcccaggaaggtccagccgagctcgtggttctctttgagcgtgctctcgatctggtcgccgagctcgagcttgcccatcatggcgttgtcggcgccggcgtcttcgttcgccacggccacggtgatgcctttcgtgttgccgtatggattccagaagccgatgatgttgaaccaggcgtagagcgcgggaatgaaggtgaggccgaagatgatcacccaggcggccggattgatgatgagtcgcttgaggtcgcgccgcagaatgaaccatatgttgcgcatgactcctctttcgcctccttccgcttggggtgcgtgtacttctcagagatacggtatacgtagcgctacggacatagtagcgttattctgctcaaggattcgcgtgaagctcctcgccatctcggatttgtgtccggattatggaaattgttccggtgatttcgcgaaacccttgtgcgcgcggcgcattctcaatacattgtgaatcgttcggaaccgcggtgcgggcgattacgccacggggctagcccggcgttacgcggtgttgcagtacgagacgaggaggcgaaggcatgagcgacatggaacgagatgcgcggaggcgtgaggtgcgggctgctggcggcacccgtctgaccgttgccgatctgatcaacgtgggcgtgttcggcgccgtctatttcgcgctcgtgggcgtcgccgcattggcgagtatggcagtgttcggcgttgccggcaacattctgctgcccgccatcgcggccgtgctcgccgggccggtgttcatgctcatggtggctcgggtgcgcagattcggtgcgatcacgctcatggggctcatgctcggcctgttcctgttcgtttcgggtcacttcgcgacctcgctcgtcacggcgatcgtgttcccgctggcggcggactgcattgccagattcggggcatggcgtcgcccatgggcgctcatgctgagctatgtcgtgttcagtttcggttgcaccgggccgattctgccgttgtggatgatgaaggacgcctacattgccagccttgaacgcaaaggcaaggacgctgcttacattgacgcgctgtttggcgcggtgaacggcacgaccttcgtggtggcgatggtggcgattgtgatcggcgcgctggtcggcggcctcttcggcatgcgcctgatgcgcaggcatttcctcaaggcggccgtggcatgacggaggtggttgttccacgtgaaactcgcgtgccgattcgtgccacccgcggcgtgctgcacttcgacccgcgcgtcaagctcgccatgcttgtggtggccaatatgatgatgttcctgcatgtggggccgtacgccggcatgatgggagtgctgctgttctcgctgcccatgctatgcgggggcaagatcgcgctgggcatgggcatgctggcctgctatgcgatgtgcctgggcgtggattggctcgccgcggccgtggcagatgcggcaccctggctgcatgtgccgggggcgttggccgctggtggcgcaatgatgctgccgtgcctcatcgccggcatgagcgcattcgcaaccacgcctcccggcgagctcgtcgccgccctgaggcggttgcatctgcccgatgcggtggtgattccggcgatcgtgctgttgcggttcttccctacgatcgcgcgtgactaccgcatgattcgctgcagcatgcgcctgcgcggcatcaatgtgggaggctgggccatgctgtgccacccgatgcgctcgctcgaatacgtgctggtgccgctgttgatgaacgcggcgaatgcggcgcacgatctcaccgtctccgccctcaccaagggcctcggacggcgacgtgccacatccagctccgccatgctgcacatgcaggcaatcgactgggccatgctggcattgtgctgcctgccgcttataccatggcaggcctagcacgggtatggcgggcgaatgacggtgatggctgtgatattcaaggaggggtatgaacgggactcgatgtgcgttggatggttgctcgttccggtatgcgtcggatgaatccgctgacggtgtggaacgcggagtgcatgcgatcgaccatgtgtcgctgcaggcacgtgcgggcgaggtcgtgatgctcgtcgggcgcagcgggtgtggcaagaccacggtgaccagactgcttaacgggctcgcgcccgagtatttccgggggagtctgcacggtgaggcccgcgtgggtggactccacgccggcgtggcggcggtggaggactatgcgaccgaagtggggtcggtgttccagaatccgaaaacacagtatttccatgcgaactcgactgacgaactcgcgttcccctgcgagaacgcaggcatggagcccagcgagatccgccgtcgcattcgcgaacggctgcgtgcgttcgacgtcgaacatctgcacgaccgcaacattgtcgactgttccggcggtcagcaacagcagctggcggtcgtggcggccacgatgctcgacccgggggtgctcgtgctcgacgagccgacgagcaatctggacgcggaggccatggaacggttgcgcaacatggtcaagcggctcaaacgcgacggcatcgccatcgtgatcgccgagcatcggctcgcatgggtcgccgatctggccgaccggtatgttgtgttcgacgccggtcgcgtggtcggcgaatacaccgcggaacaattccatgcgctgcccgagtcccagcggcgtgcatggggtctgcgtgcgctcgaactgagcgggccgcggggacaggtcgagcggatcgcgcaacgagcggaaccgtccggcgagaagccggtgatcgcaacgcgtggtctgaaggtcgggtatgagcggcggcgcctgttcggccgaaccaagcgcggattcgtgcgcgaggtgggcgatgtgaatctgttcgccgggcagatcgtggggctcatagggcgcaacggcgcggggaagagcacatttgtgaaaacggtgtgcgggctggtcgaaccggtggcgggcgagattctcgtcgatgggcgcgcggcgaaaccgggcaggctctccgcgttgtgcgcgatggtgatgcaggatgtgaactaccagctgttcgcatcgagcgtgcgcgaggagatgctgctcgaggcgatgcagcatgtgcgtacggccgaagatgcgcaacgggtgcgcgagcgcgccgatgggattctgcgacagctcggtctgctcgacttcgccgaacggcacccgatgacgttgtcgggcggccagaagcagcggttggcgatcggtgtggcgctcatgggcgagaaacgggtcgtggtgctcgacgagccgacaagcgggctcgaccgccaccatatgctgcaggtcggggcgctcatgcgcgacctggctgaccgtggcgtgtgcgtgctcgtcgtgacgcacgacgacgagctggccgccgaggtgtgcgaccgcatcgtgcggttctgaatgcacatgcggggccccgggcgaatgcggtcggggccccgcaggaacgtcagtgggcgagcatctccttgacgatctcgtcgtcgctcatcgacgccgggtagtaggtgggccagtgctccatctgcttgatcacctcgtcgtgggagtcgccggtgaagatgtggaagtgcgcggccttgccaggtgcgatgccgtggtcggagaactgcacggccttcggcgcgccctgcggcacgtcaccggtggcggtgaacaggtagcgcacaccgcggttgcccttcgcatagtcgaggatgcgatggccgtcgtagcggtaggtggccgtcaccttgcgcccgttggtcgtgaatgccatgcggtcgccctctatggtgatggtctcggtgtcggttttgtaaccggcgtcgtaataggcggtgtattcgtctgcggtcttgtcgccggtggctgccttgtgctccatcacgccacgcagcttgccgttcttgagcagcgggtagacggaacgccattggccggcgtagtcggctatggtgcggtccttcacctgctgtgtgaggaaccagccgtgctggggatcgtcggccagcgcttggttggtgatcgtcgtgagccagcccagcagcgtcttgtggttctcgggcagctgctcggtgacgctgatgatcgtcttgccgctttcgcgtgcggccgcgtcgagcttcttggcgaatccacccatttcctgcggattgacgatgagcatgtccacattcgaactccccaccgtgtcaagcgcgttcttgaggtcggaggccgagggctcggcgtcgttgttcatcgcgttcgtgtaggagtccggggttttgtcggtggcgccgatgtagtcgagcaggtggccgatgatcgattcggtggccacatagcggcgctgcaggttctttgcccgtgcgcggttgacgagcgccgtgtattcggcgtattcggcgttccaggtattcgagtggcgtcgcgcggtggcggccgtctcgctcgcttcaccggacttcgtgacgtaggcggaggtgatcgcctccgacatcttgagcacggccgccgggctgaaccacagatgcgggttcaccgtgccgtgatggtgatggtgcccctcgccctcttcgtggtcgtggtcatcctgactgtcggcgatgcccatgagcgacgatgccttcacgatgcgctggcgaccttcgtcgagctgcgccttctgggcccatccgtcgtagccggcgccgttgagcaccacgacgtcggcgcgtgcgagcttcgtgagatccgccggtgtcgcttcgtggtcatgggggtctgcggccgtggaattgatgatcgaggtcacgttgacgcaggagccgccgagctgctgggcgagcgaaccccactggttcaccgacgccacgacgttgatcgtggtgtcgcagctgtcggtggtctgccgtgcggctgcggccgaggtcctgttttctccggcgttgtttccgcaacccgacagagtgctggcggcgagtccgcacaccgcaaggccggcgaggaatgcgatcgcggtacgggtgatcggccggcgtcgtggttcgtcatgcgttgcggagcgttggtttgtagattgttctgtcatgctcgtctctgttccctctccattgtcttctatgccatctattgggaatcgttctcaataacgagcgtagcaaatgagaacgattctcaataatcgaatctgcatagtggacacaaatatgagacagcagatggtgggaatcacccatacggcatggcaagcggagtgcgcgccgcagatgcgatgtgcgcgggattacaggaagtttcgcagcgcggtcgcgtcgttataggcgcggttgtagaggttctgaatcttgtcgggatccttggtgagcgtgctcacgccgtcgatgctcttcggcgcgatgatgcgcaccttgccctgcgcctcgagtctcttgcacatattgagctcgacattgtaagtatgcgcgcggttcgccagtgcgcgtgccgcctcggggtagcggacggcgagcatcatcgagctggcgatgtctttgtcgggattgcggtagaaatcgcgcggccgcgtcagaatgacgacgagtttcgtgcagccatcggcaaacgcctggcggaacggaatcgggtcgctgatcgtgccgtcgaaatacgggcgcccatccagtgggtagggtttgtcgagcaccggcaggcaggcggtggccttgagcgcgtcgtagtgattgcggctcatggactcggggccgaggtacttcggcatgccgctgagcgcatcggtgacggtgatgcggtacggcacgccgccggccacgagcgcatcgtagtcgagcgggtcctcgccgtcttcgttcatcaatgtgccgtaaatgtaatcaagacccaaatacgacccgtcgcgcaggaaattgcccagactcatgtactcggggcgtgggcagtacttggtgtagaaccgcagcgggcggccgcgctggcccgcgaggtacgaggtgatgttcgcggcgccggcggagacgcccaggccgtagtcgaaatggatgccgttgtcgaggcagtagtcgagcacgccggtgctgtaggcgctgcgcaggccgccgcccacgtcgatgacgcccaccttctcgcggcgtgtgggtcgtgtcggctgcgtggtctgctgcaccgccatcacctcgattgcgctcgatcgtatgcattgatctgtatccattgaaatcgatgaatgaggtgcgatggcggagggcgcgctacaaattcgcgagaaatgtctgcttttttcgtgagtccccatgggagattccctatgctggtgcctatgaacgacgtgaatccgtatgcggctgcggcgcacatcgaggtgctgccgctcacgccgacgcgccagtcgatagaacgcgcgctggtggaatggatgacgcagaccggccgcccggccagtgatctgagcgtttctgcgctgtgcaagaaggcgttcgtggcgcgcagcacgttctacgcgaactaccggcatatggggcaggtgtatgaatcggtggagaaccggctgctgcgccagctcttcgagtgcgcagtgccgatgcgcgtgcgtgcagacggcaccgatgagacgatgcgttcgttcaacgcgttcgtgaaggtgctgcacgcgcatgagaacgagttccggttggtgttggtgcgccagccgagttcgcggttcgtggcgttgtggaagcaatcgctcgaataccatgtgtggcaccggctgttcgaaaccgagcgcggcggtgccgcggcagttgatgcggttgcggaatggggtgacggtgccgcgccaggtacgtcgaatggcggttcggcaacatctcaggagggattgccggctggaacggatgccgatgcgacaaaccggaacgaattgccggtgcggcaggggcctgcgacggtgaaccgggcgctcgtgttcgacatggccgcgacggcgttcatcgcgggcgtcacgttctggctgcgcacgccgcaggcggtctcgttgcccgagattcgcgcctcggtggtgaaactcgtgaacaacatcgacgagatctggtgattgttctctatcgttctcttgcctaatctgcccctctgcgattctcctctgcatctgccccctgcgattcgcctctgcgtaatttgggacatttgcactgtgttttctgtccctccttacgcagagggtgaggtgagagggtgaggctgagatggcggcacgcagatggcgcctccgactcagttcttgctggaatccgagctgccggagtcggcgttcgagtcggaatcgttggactggctgcggttgcgcgcatcgccgttcgactcgccgttggcgccgtctgaatcctgcatgcccggcatctggccgtccgcacggtaggaacggcggttccgcgagccgttgcccgagccgaagtccggcatagactcgccgtccccgtcgccttcaccgaagccgcggtcgcctatgccgcgcatcatcatgttcgaatgcgacggttcgttcgaccggtagatcgcgttcgtgaccgccgtgcccgcaatgccggcgacgaggccgcacccgaggctgatcgccgcgatgatgccgatggtcttgccgcccggtttgccgcgcaacgtcgccgtgccgcggttgcccggtgcgccgccattcatgggcatctgaccgccctgcggattgttcgggacgccgttgccgcccatgttcggctgcgcggtgttggccgccgtggtgaagggctgctcgccgttctgcggcgcatagccctggcttggcggaatctgctcgccctgctgctgcgcgaagtcgaaggcgtagccctgtggttgggtcggcgcatccgcttgggtatgcgcgatctgcgcagtgtcggccgccgcttgggtttgcgaaccgccctgcggccggatgatctcggtgttcgtgttgtcgtgctgtgccatattcattccccaatctgtgtcgatatctgtagaaaattcgcaaaccgaattgcgtatggaatcagtacagcagccgaagtttgagacgaactctggaacagattggcacagactgccgaattacttggggatcactggaaaccgtgtgaagaaattgaaagtgcccccccagggattcgaaccctgaacccacgacttaaaaggacgctgctctaaccgttgagctagaggggcaacaccgcacatattacaacgggtgcgggaaaacgcaaaatgcgggtgtgcgcggtcggcgtggcgagcgggtggcgcgctgagtagtctgtaattatgtcttgcacaacgctattggtgggaaaatcagcgagttacgacggctccacgatcatcgcacgcaacgatgactcgggcagcggcacctatgatccgaagaaattcgtggcggtgcggcccgaagaccagccgcggcactaccgcagtgtgatcagccacatggagatcgatctgcccggcgacccgtgcctgtacagcattgtgccgaacgtgcgcccaaatcgcggcgtgctcgccgaagcgggcgtcaacgaacacaatgtggcgatgagcgcaaccgagacgatcgccgtgaattcgcgcgtgctcgccgccgatccgctcgtcaagctcgtgccggcgcatggcgaacccggtgacgcggactatcgcgaagaggtgcccggcggtttcggcgaggaggacatcatcacgctcgtgctgccgtatgtgaggacggcgcgtgaggcggtcgcgcgcatcggcgagctgctcgcgacctacggcacctatgagtcgaacgggatcatcgccagcgatgtggatgagatctggtatgtggagacgatcggcggccatcactggattgcgcgccgcgtgccggacgactgctacgccgccattccgaaccagctcggcatagatttgctcgacatcgacgacgcgatgagcgaatgccgcaacaatatgtgcagcgccgatctggccgatttcatcgaggcgaaccatctcgaccgcgccatgcccgaccccgagttcgcaaaccacaccgcgcagcatatcaatccgcgcacggtgttcggcacggcgacgccgaaggacgcgatctacaacaccccgcgtgcctggtacatgcagcggcatctcaacccgagcgacgactgggattcgccggccgcgcaataccgcccggattcgcaggacatgccgtgggcgcgcgaaccggagagcaaagtgaccatagaggacgtcgcgttcctgatgggctcgcatttccagggcacgccgttcgacccgtacggcacgaccggcacggcggaatcccggcaccgctaccgtccgattggcgtgaaccgcaccgggcagatggtctgcatgcagattcgcccgtacgcgcccgccgcctatcgttcgatcatgtgggtctcatacggttccggcgcgttcaccacgcccgcgcccttctacgcgaatgtgaccgatacgccggcctacctgcgcgacaccgacggcgagaatgcgtcaacgaactcgctgtactggacgaaccgcatactcgcggtgatggccgacgcgcattactatgacacggacggcgagatcgaacagtacatcgaagatgtgcaggcgcatggccaccggcttgtcgcggacaccgacgcctcgattcgcgccgatgccgacgcgctggcgagcgactccgcgcacgaggggctcaaggcggtgcgtctggagcttgagacggcgaacaaggcgatggcagattggttgcagatgcgcacgcagacgttgctcaatcaggtgctctacacgacgagcaatctcatgcacaacgcgttcaagatgagtgaccactggatgagctgagtgcaggccgcaggccgttgcgtaataggcgcggccgctacgcaattcctctgcatgagtgcagttctcttagtgcagccctctgcgtaatttgggacatttgcacggtattttccgtctctttttacgcagaaagggccggtttgcgtaattggggacatcgctgggctgctttctgtctctttttacgcagaaggggctggcgcagagggggattcggtgcgcgtttcctccgtaccgtcattctccgcggctcgctgcgccgccttcttcgccttctcgccctcgaagcgcagttccggcttcgccttcatgcgtgacaggccgttccatgcgaggttcacaatgagcgcggcgagctgctccttgctcactttgcgctggtcggcccaatactgcccggtgaacaccgtcatgcccacgagcatctgtgcgtaatacggcacgcctttcgtggggagcttctgcttcttgaaccattcgctcaagatctcgccgacgcgcatcgacacatcgcccagcagcgacgagaacgagctcgatgggtcggtgcttggcgaatcgcgcacaagcacctggaatccctcggcgttctcctctatataggtgagcaatgcgagcgccgtgcgctccacgatctgccgcggatgcacgtcctgtgccgatagcgcggccaccaatgtgtcgttgagtgcgcgcatctcgcggtcgaccaccaccgcgtacaggccctccttgccgccgaaatgctcgtagacgattggcttgctcacttttgcggttgccgcgatctcctccacgctcaccgcttcgaaccccttggcggcgaacagcgaacgccctatgcgcagtagctgttcacgacgttggtatgaagacattctcgaagcattggccatgtgcccatcttttcacgcgcgctggaaatctgcatatatatatactgcgacacgcttggttttccaacagatttcagattcgcgcggattcgcggcactgtccgttgcgctttttacgctggggttatggatacaaacacgatttacgccattgtgatcatcgcggtcatcgccgtcgcgctgattatcggcagctggctcatcggccgctcgcgccgcaacgcgatcaacaagtcgaccgagcacgcgaaggcggccgccgacgcgcgcctggccgcagaacgcgcgcaggccgagcaggaggagcgcgaggcacacgaacaggcgaaggagcccgcggaaagcggggcgcggcaatcttccggcggcaaaccagcggagccgaccaacgaggagaagatcgaggccgaggagccggcgatttcacgcgccgaactcgaggcgcaggagcgtgagcggctgtcccagacaccgccgaagctcgccgcggcggaggaggtgccgggcgaggagtctgcacaggcggaatctgtggtcgaagacctcgccgtggtcgacgaggtgccgacgccgccggccgagcagatcgagaagccggccggcaagaagagccgactgcagcggctgcgcgaacggctgagcaagtcgagcaacccgttcggcaaggccctgttcaacattctcgcgaaagaccagctgtcggaggcggactgggaggacgtcgaagacacgttgctgcttgccgacgtgggcgccgaggcgagcgaggagctcgtggacaagctacgcaccgacgcgcgcgtgaccggtgagagtgatccgcgacagctgcgcgacgcgctgcgctccgagctgctcgcgctggtggggccagacatggatcgcacgctggaggccgagaagccggatgcgaagaagccgagcgtcatcatcatggtgggcgtcaacggcaccggcaagacgaccacggcgggcaagctcgcgcgtctgttcgtctccgaagacaagaccgtgctgctcggtgctgccgacacgttccgcgccgccgccgccgatcagctcgagacgtggggcgcgaaggtggacgtgccggtcgtgcgctccgaccgcgagggcgcggacccggcgtcggtggcgttcgaagcgagtgcgaaggcgaaggaactcggcaccgacgtgctcatcatcgacaccgcgggacgcctgcagaacaaggccaatctgatggacgagctgggcaagatccgccgcgtggccgagaagaacctgccggtggacgaggtgctgctcgtgctcgacgcgaccaccgggcagaacggcatggcgcaggcgaaggtgttcgccgaggcgatcggcatcactggcgtcgtactcacgaagctcgacggttcggcgaagggcggcattgtcatctcggtgcagaaggagctcggcgtgccggtcaagctcgtcggcgtgggcgaggggcccgacgatctggcgcccttcgacccggagtcgttcgtggacggcattctgggcgagtgatctgagttcgcgcgcctttcgctcaaccgccgctggcattctggcaatgccggcggcggtttccgttatgcaatgcaaccacaaatgcggaatgggctcatatggttacactctcgtaacgcgtcgtaacgttctcaaaactcggcgggggttccatagcacatgtgggttccgtaggcccctcgccgagcggagccgcgaaagagagttatccgttgtagaggcggatggaaagtatagaaaagagaggggtgttcgcatgagtcagcttgattccggcaacgccgcgtggatattgacgagcgcctgcctggtgtttcttatgacgcctggcgtggcgctgttctatggtggcatggtccgtgccaaggccgtgctcaacatgctcatcatggaggccgcagcgctttccgtcacgatgatcatctggggcctgtggggctggtccatcgcctacgccggcaattcgatcggcggtgtgttcggcgacccggccaccggcttcctgcttcgtgacaccatggttgcacaggatggcgtgttcacctccgccagcctcaacagcaacaactacccggccagcgtcgacgtcgcattccaggccgcattcgccatgatcaccgtcgcgctcatctgcggtgccatcgccgaacgcgtcaagtacagcacgtggatgatcttcgtcgcgctgtggatcaccttcgactacgccccaatggcccacatggtgtggaacggcggtctgctttcggcggatggcgcgatctcccaggctcttggcgcagccgcccacgattttgcaggcggtaccgttgttcatatcaacgccgcagtcgcagccctcatcatcgtgctcatcattggcaagcgcaagggcttcggtgtcgaaccgatgcgcccgcacaacgtgccgttcgtcatgctcggcgccttcctgctgtggttcggctggttcggcttcaacgccggctccgcattcgccgccaacggtgtcgccggctatgcctgggtctccacctcgctcgccgctgccgctgcaatgctcacctggggcttcaccgagaagattcgcaccggccactacaccgcaatgggtgccgcttcgggcatcgtcgccggtctcgtcgccatcacgccggccgctgacgtggtctcgccgatctgggccatcgtgctcggcgccatcgccggtgtggtcacctgcctggcctgctcgctcaagttcaagcttggctacgacgattcgctcgacgtggttggcgtccatggcgtcggcggtctcgtcggcaccgtgctcctcggcttcttcatggaaggcactggcctcttctacagcggcaagtggaaccagctcggtgtgcagctgatcatcgccatcatcgccatcgcgttctccgcggtgatcaccacgatcatcgccttcgcacttgagaagaccattggctggcgcgtcacgcaggcccaggaagtggccggcatcgacttggccgatcagggcgaacgtgcctacgatttcgctggtaccgccagctctgttattagggagatgaagtgagatgaagctcattaccgcaatcattcagccacataagctcgacgatgtgaaggaggcgctcgcctccgccggcgtgcacggtctcaccgtctccgaggcgaacggctacggccgccagcgtggtcacaccgagatctaccgcggcgccgagtacaccgtggacctcattccgaaggtgcgcgtggaagtgctctccgatgatgccgatgccgagacgttggtcgatgtgatcgtcaagtccgccggctccggcacgatcggcgacggcaaggtctgggtcgccccgctcgacatggtggtgcgcgtgcgcaccggcgagaccggttccgccgcgatctgacgcctttacggatttctccagataaccctaagtgacatccccgccacgcacggcccgtgtacggcggggattgtcatattcgcgcgtggcctccctgcgtaagttatgcgccatcccctcctcccctgcgtaattggggacagtttcagactgcagtctgtcccttttacgcaagtcattactttgcgtaatttgggacatttttggcgctatctgtctctttttacgcaaggtatctttactttttacgcaaaaagggtgtgcatgcaaagggcacaacaagcgcaacgaaatgagaagagatgagaacatggcgatgagcacattgaaacagcagttcctcgagctgagcgagccggatgccgacggcgtctaccgcaatggcagcgccaagcgcatggcccgcacgaatctggcgatgcgcgagcttgaggcattgtggaacgaggccgtgcactccgtgccgttccagattcccgactccggcatcggcctggccgcggtgggctcgctcgcacgcgggcagatcggccccgcctccgacctcgacctcgtactgatcaccgccgaccatgtggcgctctccaccacgcagctcaacgaattcgcaaacaagctgtggtatccgatctgggacagcgggctcgacctcgaccattcggtgcgcacggtgagccgatgcgaatcggtgaccgaccacgatctgcccgctgcgatgggctggctcaacgtgaacccgatcgccggcgaccggcacctgatcgagaccacggccacggcgatcctcgaacggtggcgcaaggcggcgcgcaaacggctgcccgaactgctggaatctgcaaacgtgcgcaacgagcgcttcgacagaatgtcgtatgtgaaccagcccgacatcaaggagtcgcgcggcggtctgcgcgacacggtgctcctctccgcgctcgccgcctcctggctcgccgaccgcccgcacggccgctatgacgacgcggtggaacgtctgctcgacgtgcgcgatgcaatccatttgatcacgcgcaaagacgcggacagattgctcacgcaataccaggccgaggtcgccgcgatgctcggtctcaccgatcccacgctgccggagggggagcgtgaggcgaagtcgattgacgacctgcagacgctgctcgcgagtctgagccgcacaatcgcgttcgcgctcgattcgaccgcctcacgcgcgcaacgcacgctcgtgcacgacaagccgcggttctcgttcttccagattctctcaccgcgcgccggcggcaagcgcgaggcgccgaaattcgagatgctcgcgccgggcgttgccaaacacgagcaggagatcgtgctcgccccacaggcggacccgctcgccgaccccgcgctgccgctgcgcgtggccgcggccgccgggcgtgagggtctgccgatcaatacgtccacgttggtgaatctcaaacgtgcgccgattcacgacaaggcgtggagtgacgagatgcgccggctgttcgtggaattgctggcgagtggcgagcggttgccgcaggtgtgggaggagctcgatttcgtgggcattccgggcagactgatgcccgaatgggacgcgattcgcaaccggccgagcgtctccgcggcgcatcgctacacgatcgaccggcatatgctcgcagtgaccgcgcaactggggcgtgagcggccagtcaacggcggcgccttcgatgacgtccactacacggcgttgctgctcgcggggattctgcacgacataggcaagcggccgggcgtagccgatcatgcggcggagggcgcgcgccacgctgcggtgattgtgcggcgcatgggattcgacgatcagatggtggattgggtgcgcctgctcgtgcgcgaacacctgacactctcggatttcgccagctcgcgcaacccgaacgacccggaggtgggcgccgaactggcgtcgctggtggacggcgacccccagctgctcgacatgctgttcgcgctgacgaaggctgacatgtcgtcgctgggcgccaccgccggcgagacgatctcgaacacggtggggtggagcaaatggcgcgcgcgtctggtgacgcagatggccgcgctggcgcgtgcctccatgtgagcgtttcgccactgtgattatccacaacgggaacatggtcgtgtggataactgcacaggttatccacagggttatccccatcatgtggataactcgaggattctcccacagttatccacaggtgattttatctatggcgcccgcgcccactcttcaccttgtcattcatcgatttctgcgcatgcgcctgcatctgcaatcattggtagtaaggacccggattgcatgaatgtagcatatatgctacattctattgatggaaaggatagtgttcgaagtatatgaggacgcctcatggcgagatagatcgtgccatgagaatctacagattactcgcacagaaaggagagtgaggagtttatgcgcagcttcaacagcatgcttgatgaacagatggacgatcccgaattcgcgacggtgttcgaggccgaaatagagcgtttgaatgcggcggtcgccgtatcgcgggcccgggaggaggcgaggctcacccaggagcaactggccgagcgcagcggcgtgagcagagtgaccatcaacaggatagagcggggtaaactcaatccctccatgaagacactgtcgcgcttggcccgagccatgggcaagcaggtgcgggtgtccatcagctgaatggcatgcgacaccgcgcgtactcagtacattgcatgcccccttataatcgagagctatggctgacggattccacaacaacactcgcaccgacaccagcgccaatgccgctggtctcttcgaccgcgtccccccgcacgacgacaacgccgagatggcgacgcttggcggtatgctcatgagcaaggacgccattggcgaggtttcgcagatcgtttcggtggatgacttctatgagccgaagcaccagacgatctacgaggcgatcattggcaagttctccgcatccgagcccgcggacgccgtcaccgtggccaacaggctgagcgactccggagacctcgacaaggtcggtggcatcgactacctgcattcgctcatcgcctccgtgcccacggctgcgaacgcctcgtattatgcggagattgtgcaccagcgcgcgctgttgcgccgcgtgatcgcctcgggtacaaagatcgcgcagctcggctatgacgccgaaggctcgcaggcgcaggatgtgatcaacatggcgcaggccgaggtgtacgagatgagcaccggccgcgtgcgccaggactacgcccccgtgcaggccgccgtgcacgatgcgctcgaccagatcgacagcattcagaaaggtgagctccaggcgggcgtgcccaccggcttccaggagatcgacgaggtgaccaagggcctgcagccgggccagatggtggtggtcgccggccgcccggccatgggcaagtccacgctcggtgtggatttcgcgcgctccgccgccattcaccaccacgacacgaccattctgttcagcttggaaatgagcaaggtcgaacttgcgcagcgcatcatctcggcggagacgggcgtgccgctggccgccttgcgcaatgccgacgacattgacccgaaccgctggaacacgctcaacaacttctatgcgaggcttcaggacgccccgctgttcatagacgattcgccgaacatgagcctcatggagatccgcgcgaaatgccgccggctcaagcagacgaacgacctcaagctcgtcgtgatcgactacctgcagctcatgacctcgggcaaggccgtggaaagccgccagcaggaggtctccgagttctcgcgagcactcaagctgcttgccaaggagctcgaggtgccggtggtggcgttgagccagctcaaccgtggcccggaaatgcgcaacgacaagaaaccgcagctttccgacctgcgcgaatccggctccatcgagcaggacgccgacgtggtgttcctcgtgcaccgcccggacttctacgacgaagaggaccgcccgggcgaggctgacatcatcatggccaagcaccgcaacggcccgacgcgcaccttcggcctggtgttccaaggccagtactcacgcttcagcgacatgaaccgcgaggtgtgacgcggaggcatctcacgggtgggcgcggcatgcgagtatgaattggcataacaacagcgaacacgattgacgacacgattgacaagaggcaggcatatggcagattccggcacctccaatgcgaacccggtgcgcacgcacgcaccctggtatggctttgcgaccccgttcgtgggcaaatccgtgcgctgggcctcgcgcctgctccatcacggcggcagcgcgttccccggcaaggtggtggaacggttcgaccccacgttcctgagccgcacgctgagcacattgccgctcggcgtggtgctcgtctccggtacgaacggcaagaccaccaccacccgcatggtcgccacgatgcttgaatcgctgggtctcaaggtgttcacgaacccgaccggctccaacttcacgcgtggcgtcgtctcgtcgatcctcaccgaagtgccgctgaacggccgcttggacgccgacatcgccgtgctcgaactcgacgaggcctacgccgtgcacttcgtggagcaggtgcagccacgctatgcgctgctgctcaatgtgatgcgcgaccagctcgaccgtttcggcgagatcgacaacaccgctcggcttcttggccatgttgccgcggcgacgcgcggtaccgtggtgctcaaccgagaggacccgcgcatcgcacgcctgcgcgacgtggtgaaggacggcgtgcgcacccgctacttcggcttggccgaaggcctgcgccattatttccccgccgacgacgatatgaccaccacgttccaggtgcagtccgcagactcggcgcaggctcccgaagctgcggatgcgcagatcgtcgacgtcgcgcacgatgtcggcaccgcgcacgagctgcacgccgacgtcatgctcaccaaggtgggcgaccaccatgcgcagatggtgatcgacgggcgtgaatacgagtccgacgtcaagctggaaggcgtctacaatctgttcaatgcggccgctgcgctcgccgtggtgcgcgccgtgcaggctgacctgcgcaagccgaacgcggtggggtacgcggccgcccaattggggcgtgcagattctgcccgcgcccgcgcattcaccgcgcgcgctcacacattcgccgacgccgacaccgacgcgctgttcgccgcgctcgccgacgtgacgccggcattcggccgcggcgaggtgatcgacgtgaacggttccccagtggagctgctgctcgtcaagaacccgatgggcttccgcctggcgctcgcctcgttcccgcctgaaagcgccgacacgatgattgcgatcaacgaccagtacgccgacggccgtgacatgagctggctgtgggacgtcgatttcacgagtctgcggcccaccggcgtcgcgatggtgtccggcgtgcgcgcgtgggacatggcattgcgtttggaatacgaccaggtgccggtggcgagggtcgaacccgacctcaacgctgccgtgcgcgagttcgtcaacgcgaatccgggcacgccaaaacacatctactgcacgtacacggccatgctcgccattcgtgccgagctcgccaccgtggccgacgtggcggacgccggcgtgggcaagtaggtagcggattcagcacagcagattttccgattgggcaaatacaagacaggagtaggggaggagccggaatgagcaaagcaatcgacgtggtgtcgctctacccgaaagacatgaatatatacggcgacagcggcaatgtgctcgccgtggagcgcaggctcgcactgtacgggtacgagccgcatgtgcatgccgtgaaccagaacgacccgtggcctgagcatgccgacatcattctgggtggcggcggccaggacaccggtcagaagaagatcatcgaagacctcttccgccgtgccgacagattgcgcgacctcgcggagcacggcgtgccgatgctcatgatctgcgggctctaccagctgttcggcgagtatttcgaaacgatcgacggcacgaaacttgagggcatctcgatcattcgcgcctacacggtgggtcgtgacgtgcgcatgataggcaatctcgtcgagcacagcgcacagttcggcgatgtgcttggctatgagaaccactccgggcagaccttcctgcgcgagggcgtgcagccgctcggcacggtggacggcgacggcacgggcaacaacggcgaggaccacaccgaaggcgcgcgcgtgcacaatgtaatcggcacctacatgcacggctcgctgctgccgaagaacccgaaaatcactgatttcatgatccgcacggcggtcgaacgccgctacggcgcattcgaccccgagcagaccgacgcccagcgtgccgagctcgcgcggatcgacgaatacgcggcgcacgcgcgcgaggcggcggctacacggccccggtgagtgtgagaatctgtgctctcgggtaaaaaacccacggcgtgaccgtctgcgtttgcgggcgtgtagagttgagcgtaccagcttcaacacacacccaggagggcactatgactgacgaaaccaagaacgaaaccgagaacaagaccaactccgccatgccggacttcggcgaaggcctgcgcaaggtgttccttgcgggcgtgggcgccattgcagctactgccgagaagggtcaggagctcgtgaacgacctcgtcaagcgcggtgagctcaccgtggagcagggcaagaagctcaactccgaactcgcccacaaggccggcgagaagtccgactcgctcaaagagaagctcgcagacgcctccaacaccgttcgcaatgcggccgcaggtctgagcgaccaggccgagcagacgattaagaaggccaccgagaagaagtccgacgagcagtgattctgtgattcccctacgcgtgcgccgtctggattcaggcggcgcacgcgtgtatgttcacccgtatgcgccggcgacgccggcctcccgactgggtaggattcttatatgagcgacaagaacagcgacaagtccaagcgagaaaccgaggcgcatgagctcaggcgtgacgtgcgacgcgaggaggccgggcagcgcaggcagcagcgcaaggacgcctgcgaggcacgccatctcgaacacgaggagaagcgcgagacctccgagctcattgacctgagcaaccgtttggagaaccaggaggcacacagcgacggcccggctttcgacaatccgaccgacgacgcattgcgggcgacggtggagaccgccgaatccgagaagatcctgcatcttggcgatgaagtggacgagcaaggcgccaccatcgaacacaatctgcagcgcgaggaagccgagcagtccggcggtgaggcgagcgaaaccgcggcacagccggaaacgccagcgccgcaatctgcgcagtccgaacgcccggcggacgcgcacacccacgacatcccggcgagcatcgcgcgcaggcagcagccgcaggtcgaggagacgatcggtctgttcggcatgcataagcgcaatttctcgagcgaataccacctgacgcgcatgagcaaggcgaaacgcctcaagcagatcggcaagatcgcgctcgaatacgacgcgctgcacggcctcacgccggtcaagatgcgcctcatgttcgaagcgctcgggcccaccttcgtgaaggtcggtcagattctgtcgatgcggtcggagattctgcccgagtcgttctgcgccgagctttccaaactgcgcgcggacgccgacccgatgccgtacgcgattgtgctcggaacactggagaacgaataccagcggcccatcgacgagatcttcgagcacatcgacactacgccgctcggttccgcatcgctcgcgcaggtgcaccgtgcgacactgaaaaccggcgaggacgtggccgtgaaggtgcagcggccgggcgtgcgcgaaacaatggcgcaggacgtctcgatcatgcgctcgctcgccaagggcgccacgaaaatcatgcacagctcgcaggtggtcgacttccgcggcgtggtggaggagctgtgggagaccttcgacgaggagacgaacttcctcaacgaggcgcgtaatctggccgaattcaaacggttctgctcgcactatgcgtacatggactgcccgacgccgttcactgacctgtgcaccgagcacgtgctcgtcatgcaatacatcgacggcataccgatctcgcatacgcgcgagctgatcgacgacggctactcgctcaacgagatcggcaccaagctcgtcgacaactacgccgcgcagattctcgacgccggcttcttccacgccgacccccaccccggcaacatcgagattcgcggcggcaagattattctgctcgacctcggcatgaccggcagactcgacgcgcgcacccgcgtggcgctcaaacagatgctgttcgccgtggccaagcagaactcagcggatctcgccgacgcgctgctccgcttcgccggcaccgatgtggagcgggcggactacccgtcgctgctcggcgatctcgacggcattgtggaggagttcggcaccgtggacctcgccgacctcgatctggcggcgttcatcacctcgctcacgcagatggcgcgccggcacggcatagagatccccagctcggtgaccacggtggggcgcgcgctcgtgacgttggagggtctgctcgacgagttcattccgaacgtcaacatgatcgagatcatctcccagcacatcgaatcgtcgaaaacgccggtggagatggtgaaatccgaggtgaagagactcggcatagagagcgagcaggcgctgcacagcgggcttaagggcatcgtggacgcgcagaccgccctgcacatgctcacgcgcggcgaactcaagatgaatctcgagctcgtgggctccgaggagccgctcagccagatgagcgacatggtgaaccgtctcacgatggcgctcattgtggtcggcctgttcattggctcctcgatcgtgtatttcgccggcatgaagccgatcatcttcggcataccggtggtcgggttcctcgggtacgtggcggcgttcgtgctgtcggtctggatcgtgatcgacattctaatcaaacggcacgcggcgaaacacaaggcgcgcaagtagcagcacagagggtggcgcgcgctgcatagctgagcgcgtaggctgcgcgcgtgcgcggattcgggtaatctcgtgcatagtgacgtgctttcgagtttagggagggcaatatggccaatgcattgaagaaagcgctgattggcggcgcagtggccgcgggattgggcgtgtgggcggtggccccgcgcactttcaacaacaaacggaagaacttcgtgcccacgctgccggatgtgctgtatgcgcaccgcggtctgcacgacgccggatccggtctctcgcaacagcatgccggcgaaagcggcgagtacatcgcgctcgcgcgtcgcatggcattgcgcgccgggtacggctccatcgacgagcccggcccgctggcacctgagaactcactggccgcgtttgcagcggcggccgaggcggggtatggcatcgaactcgacgtgcagctgacgctcgacaacaaagcggtcgtatgccatgaccccgatctgctgcgtgtggcgggagatccgcgaaatattcgcgacctcacctacgacgagcttgtgcgcatcccgctgttccccacggcggctcccggtgccgaggtctccccgctgctgcccggcgccaccgagaatccgccgcttgtgaccacgccgtcgcaggcgccggccgggtattaccagcatgtgccgctgctcgaggatgtgctgcgcgtggtggacggccgcgtgccgatcatcgtcgaattcaaattcgagaactaccgtacgtgggacgaccgcgacgaggagctcatgcagaccgcggccgccctgctcgacgcctatcagggactgtatgtggtggagtcgttcaacccggccgccatgaactggtacaagcgcgagcaccccgatgtatgccgcggccagctcgccgaagacacggagttcacgaagaacccggtgctgtggatggccggcaagctcatgttcaacgagatctcccgcccggattttgtggcctacgatttccggaacggcaacggcgccatgttgcgcttcgtgcgcagaatgggcgcgatggccgtggcgtggaccgtgcgcacctccgacgagctcgcgggcgcgcagccgtacttcgaccgcttcattttcgaggcgttcgtgccgaagcagtgagtctgagcgttttctgacctgtactcctcaacaaaaaaccgtaccctcgaacatgagtagatctgttcgggggtacagtttgtcgatatgctagttcagtcgatgacgccgtagaggcggtcgccggcgtcgcccaggccggggacgatgtagctcttgccattgaggccttcgtcgacgccgcacacgaccacgcggaagttgatgtcttcgcgaatgttctcttcgacgaacttgatgccctccggagcggcgatgatgcagatcgccgtgacatccttggcacctttgtccatcaggtagtgcgtcgcggtgacgagcgtgccgccggtcgcgagcatcgggtcgatgaggaagcactggcggccggagagatcgtccggcagacggttcgcataggtgatctgctgggtcgggtgctcctcgtcgcgcttcattcccaggaagccgacctcggcgctcggcatcatgcgcgtcatgccgtcgagcatgcccagaccggcgcgcagcaccggcacgatgatcgggcgcggcttggcgatctgcttgccgaccatgggcgcgaccggggtttcgatcggcttgtctacgacctcgagattgcgggttgcttcgtaggcctccagcgagacgagctcggagacgagttcgcggaacgtggaggagggggtgttcttgtcgcggagcaccgtgagcttgtgctcgatgagcgggtgattgagtacatgcaattccatagttactagagtaagccttgtttgtgttcgcgggtgacaaaacacgaaattcagtgccgaattatgcgttcagattgcgcacgctgttgagaaaacgccggaccgcaaaagcgcctgtcggcgcaaaggccgctcgcagcggcaaaaaacggagcccggggctatgtacggcccggcgcaacactcaagcttacaccctccgccaaggtgtgtcggcctgcagcgcgccgaacgatgaatctgcgatctcatatggcaaatatgcgcgagagtgcacgggtttgtcgtgcgggcaatctgcagatatgacaaacctgtgcatgagcgcatatgttcgtcatgttgcgggcctgccaatgcgacgaatgcgtgcagattcgcactggtttgtcacgcgggaagtgcgcgccgcgcaaaccggccggttactcgagcttgccttgacgccacagggccgcgccgtgcttgaaatccttgctcgtgatgttcagattcgccgcggtatgcagcagttgcgcggcctgcgtgcgccaccgtttgctctgctcggcggcggaacctacaggattcagattcgcctgctgcgtgagctcgcgcgcctcgacgcgcaacccgagtgcgacgatgccaacgaacaccgatgcgcgcgtcaacgcgaccgcgaaatccccgcggaacgcgccggtgagaatcgagtccgcagtgcgcgcgatgtcatcttcggtgggggcggagtccacgccggcgatcgcggaggcggaggtggcaatcggctcgcccaggcgccatagccgggcgattgtatcgcgctgcttgcgcatccacgaccgcagcagatacaagcgccacagcacgccgggcagcgagtccggctccgctttgctccacagttcggcgatcacgtcgaccccctcgcggtccaccagcgtgagcacgcgctccacaatggcagggtcgtcggtcttgtgcaccttgctcagcagggcccaggcggtcgtgtgggcgacttcgcgcaggcgctcgggatcgacgtcgctggccagtccctcggcaatcgcctgatcgagctggccggggcgcgcggggcggggcgagcccgtgtgcgtgaatgcggagcggctcgcgataatcgagccggagccggaatgcatggaattagtagacaataggcgtcactttctgtatgtcgatgatgcgcgggccgtcttcggtctgcacgaggaacagcgcgaacgcgttcgccgtggccatgtacggcgatttcgcgacgagtctcttggccagcgatttggttgcgcacaatgggcgcagatgttcaaacataccaccgatcaccggcctgtgcatgcagatcgccatcgtgttgccggtctcgagcacgcgtttgatctgctcggcgaagcaatgccaggccgcctgcgggtcgcgctcgaacgcctcctcggtgagcggcggcagtgcgcggcgctcgcgtttcgtttgccaggagagcatctctatggtctgttcacagcgggtccacggcgaagtggcgagctcgaccggattatagcaggcgagttcgcggtcgagcgcatacgcggcggcggcgccctccggggtgatcgggcggtgcggctcggtgccgtcccactgtttgcgcggctccgccttggcatggcgcacgagcagcaatggcgtcgccttgagcgcatcctcctcgatgcggtccacgaacagcgcgagcatatcgcggtcggtggaatgcgtgagcctcttgcgcgccttgtcgagcgagagccacgcaatctcgctcacctcacccagatcgaccgcgtgaatggggccgaaggcctcgcggcggtgccagttgtcgtcgtcgctgatttgcgtggccatccagtacagcacatgcttggtcgcgtccttgccgtctccgcggcccgtgtgacgcgttttcttgccctcggaggagagcgggtactccacttcgcccaggaacgggccgagcgcgacggggaagccggtttcctcgccgatttcgcgcaccgccgcgtgccggtgcgattcgttgatttccagtttgcctttcggccagctccagtcatcgtatttcgggcggtgcacgaggcacacctccacgtcgttcgcgctcaacggagccatcattgagccgatgctgcgcacaatgcggtacacgatgccgcccgcagcctccacagttcgtttctcactcatggtttcagactacgccattcgctgcgaaaaaagattcctctgcgtaacaagggacattgtcgcgctcgcaatgtcccttgttacgcagaggaatctatttacacagattggcggcaggtcagttcgtggccttcttgcgcatgtgcttcttgatcaggtactcctggcaatcgagcagcggcttgccttcggcgtccttcgaatggcgcacgtaggtgccgtcgggctgcatatgccagctggacgtcgtgtcggccatctgcaggtccacgtagtcgatgagctcctgcacctgctcgggcgcggtgatgcgcacgagcgcctcgactcgacgatcgagattgcggtgcatgaggtcggcggaaccgatccacacctccggtccggaaaccgggccctcgccaatctgcggaccgtcggaattcgcgaacgcgtagatgcggctgtgttcgaggaagcggccgagaatcgagcgcacgcgaatgttatcggaaagcccgggtacgcctggcttgagtgaacagatgccgcgttcgacgatgtcgatcttcacaccggcctggctggcgcggtagagggcgtcgatcgtcttctcatccacgatcgagttcaccttgatcttgatccacgcttccttgccggcgcgcgcggcctcctcctcacggcgaatgcgctggatcagaccggagcgcacggtgcgcggcgcgacgagcagacggtggaaactcgacttcggcgcgtaaccggacagctggttgaacagcttcgtcatatcctgccccaccaccgggtcgcaggtgagcaggccgagatcggtgtactggcgcgcggtcttcggattgtagttgccggtgcccacatggcagtagcgggtgagcccgtccgcctcctggcgcacgacgagcgagagcttgcagtgcgtcttcaatccgacaatgccgtagacgacgtgcacgccggcacgttcgagcttgcgcgcccatgcgatgtttgcatcctcgtcgaagcgcgccttgagctcgacgagcgcgagcacctgcttgccggcctgtgcggcgtcgatgagcgcgtcgatgatcggcgagttgctcgatgtgcggtagagcgtctgcttgatggcgagtaccttcgggtcggcggccgcctgcgcgaggaacgcctgcaccgacgtcgagaacgagtcatacgggtggtgcagcagaatgtcgcgctcgcgaatcgcggcgaagatgtcttgcgcacggctcgactcgacctcggcgatctgccggttcgtggtcggcacgaagggcgggaatttcaggtcggggcggtcaatgccgccgagttcgaagagcacggtagcgtcgagcggcgccggcagacggtacacctcgtccggcgtcacgcccatctggtcggcgagcagctgggagaggaacggcgaggtctcatcggagatctccaggcggatcggcggcccgaaacggcggcgcagcagttccttctcaatcgcgttgagcagattctcggcgtcgtcttcctccacctcgatgtcttcgtttcgggtgacgcggaacgaacgcgcctccttgatgatcatgcccgggaacagcgtctccaaatgcgcgatgatcaggttctccatcgtgatgaagccgtagcggacgtcctccgcctcgtcttcggtcatgtcgtcgacggggacgagtctgtcgagattgtcgggaatcttcactcgtgcgaagtgggacttgccggaggtcgggttctccacgagcacggccagattgatcgaaccgcccgaaatataggggaaggggtgcgccgggtccaccgcgagcggcgtgagcaccgggaagacctgctggcggaagtagcgggagaggcgctcctgctcggcgatcgtgagcttgtcccagccgagcagctggatgttctgcttggcgagttcgggcaggatcgtgtcgacgacgtaatgcgcatgctcgtcctgcaagcggtgcgcctgctcggagatcgcgcgcatctgctggcgtgggctcagtccgctcgcgctcgtcacggcgatgccggtgtcgatgcggcgcttgagaccggcgacgcggaccatgaagaactcgtcgagattgctggcgaagatcgccgcgaagctcgcgcgttcgatgatcgggatcgtctcgtcctgcgcaagttcgagcacgcgtttgttgaatttgagccagctgagctcgcggtcgaagaagcggtcgggtggcagcgggagctcgccctccatgttctcccgcttgtcgcttttgtccgtttcagcgatgtgttcggcaatctggctgcgcaaaatcgccttcgatggtgcgttgaaaatctgtgacatggttctactttagaacgagcgggctgaaaaatcactgagttcacgaaagaattcggaatatgtccacggatgggcccgtttcgcggtgccgatccgcgctgccgtttccgtgcggcgggcgttgagctctgcgcgggagatggtttggatgattgcggccatgcggattgcccgacgcacaacaaaacaccatggtacattcgcggacttcgtatgttcgtgaaaatgtgagattttcggcgaacagtgagcgacacgccgaagtattgccgctgtatttgagtgattgaacatctaggcggctgaagtgaacagaatgtgcgattttctctgtgaggttccttgttgaaatgaacacggaaagataaaaagagcacatgtggtcagattgtgacgcttaggcgattccgacttgcgtaatcctaaattccgagcataattgcaagtacaaggacaaccgaagagcagacccacaaaagtagatgatcagcaagattattacgttgggcgggcaatggaaagacttaccgttacaacgatgaggttgtgcagagattctgcctcgttggacttgggaaagagacccacctcgtgtgggtctcttttttatttcatgaaaaaacgcctttgttttggaatagttcttggcaagaagtctgcggcggtgtatgtgactcagcggcggccgcgttatccacatgcccggcgacccgcgatgtggataacgcgttctccgaccacaatgcctcgtagagattgaaccggttgcggaacccacgttcaatgcaactatgactatgcagatcagtgtaggggcgccgcataccgagcgccatgggtggtcgttccatcggccacaggtaatgaacggggcatgcgcgcgtgatgtgcgcatgcgtgacgcgcgcgcccgcaggccgtggcaggcggagtctgcacgcagggtgcccgcataccagccagtgcacgcgatggcggaacctgcgtgctctccgcagctgtcgccgcccgcgcgccgaacccatgcgggggcgcagcacgcgcgcatgccggtgtgtgcgacgcaggcgccgtgcgagaacgtgatcacgctgtccggcgcgagcggcggtgcaggaacgaccacactggcggccatgctgacccgcgaattggcgaagcgagagaacgagtgcgcaatcgtggacgccgacgtgcgcgcgggcggcggcggtctggacgtgctgctcgggattgaacatgagtccgggtcgcggtggcatgacattcatgcgccgctcggcgagctcgatggcgaggcattgcgtcgcagattgccacactgggacggcgtgggcgtgctcgcatacaactgctgggtgcaggaggagccggcgtggttcgagatgcaggcggcactgcagtcgctggcacaggtgagcgatgccgtggtggtcgatgccgggcatggattggagattgagcatgtgcccgcattggttgaggcctcgcacattgtggtggcggagctcaccgtgctgggattggcgcgtgccaaggcacatatcgaatggctgcgtcgcaatggcgagcgcaatatggcgcgtgcgcaggagccgccgcggccgggggaggagtggaagccgattgtgggcgtgccggggcgtgtgatcggcgtgctgtgcgtggagccgcctgcggttgcgaagggccgcggggcggtgtcgttggaggaggcgcgcaaatacttgcagatggagcatatggagtgcgagctgatgggcccggtccgctccgatgccagactctgtggcgacattctggagggcttgggaattcggcgcgtgcatcggcgcaatgcgcgcgtgctcggcgatgtggccgagatggtggagcgtgcgtgcggcataggaggcagatgatgtggcagattgtagggccgaatggggtgacgaacacaaccggcggcgtggcggttccgcttcccgaggcgccggtgcctccggatacggcacctcggcatgccggtgtgggcgctactgtgcagaccgctgcgcagaccactgtgcaccccgctgtgcgtgccgtgacggccgtggatgccactcgcccggtgaatttcggcccgctgaaacggctggctgcggatccgcgcgtcaccgacatcctggtgacctgcgacggtgccgtgtgggtggagcgcgggcttggcatagagctcgagcacccgtccattccgctggattcgcctgccgtggtgcgtcgtctggccgtgcagctgtgtgcgcaattgggtgagcggctcgacgacgcccgccctatagccgatgcgagcggtgctgacggcacccgcgtgcatgcggtgatcgcgccggtggtgccgtatggcgcgtcgatttcgattcgtctgccctcccgcatgagcgcgaccatggatgcattgcagcaggctggttgctggcctgcgcaatggcgtccgatactggatcgcctggtgctggcccgcgccaacattctcatcaccggcagcaccggctcgggcaagacgacgttgctcaaggcgctgttgctcaattgccgcgcatccgaacgcattgtgctcgtcgaggaggttcgcgagctgcaggggctcggcaatctcaacacggtttcactctgcgcgcgagccaagaacgtggagggtgccggcgaggtgacgatgggcgatctggtgcgttccacgctgcgtatgtacccgacccgcgtggtggtgggcgaatgccgcggcgaggaggtgatcgacctgatgcgcgtgctcaactccggccattgcggcggcatgagcacactgcatgccagcggggtgagccgtgtgcccgggcgtctgatctcgctggggctgctcgcgcatgttgagccgaataccatggcgggtctggccgacggggccttcgacgtggtgcttcacatggaaaggcgccccggcaaacggtacttggcgcagatcggcatgctgtgcatggtggagggcaggctcgtcggccgcacggtgtgctcgtgggatggccgtggcgagcctgtcgccggcgaggcatggcggccattcgccgaacgttggggcaccaagcgggtgccggaacgaaggtgagacgaatggcattcgtggctgcgctcgcggcggcgctgagtgtgctgttgatgatatgggccgcccctgcggcggtctcatggcgcctgcagacggtggaatcgggcgtggctgaccatgcgtgtgagccggcatgcggcatcagcgtcatgctctcgtcgatcatcgcatcgctgcaggccggtgccgcgctggagcccgcgctcgaacgcgcatttgactcggtgttcccggagcgccggtgcggaggtgctcgtgcgcgccacatgcgcgaccccactacgtccggcgacgggcatgccgtcggtgtgtatgccgtatgcgatggcgagggcaacgtggatgtgacccagatggcgcgcttgttcgcagcatgcagactgccccatgagcgcgcctcgcactgcgcgcaggtggcctgtggggtcgccgtggccagcgcggtgagcctggaactggggtgcccggccgcacgctgcctcgaggcggtgcgcgcaggctatctgcgtgcccggctgcaagacgatttgcgcgcgaatgccttcgcgatgcccaaatccacggcgcgcatgctgctcgcgctgccggcggtggtggtgttcctgggagagctgctcggcgcggatccgttgggcatgctgttcggctcggcacaggggcgcgccatgctgtgcctgggcacgatttgttatgtgggcggactgctgtggatgcagcgcctgcttgccgcggacgggtagtcctgtggctggattctgggcgtggtgtgccgcgatctgcgcggcgctcgcctcttacttgcacatggttgggaacgagcggattgctgcacgtcggttgcgcgaacttgacggactggcgcgctcgcagattgcgctggcggggcgcggcaatgccttgcagcggcgattgctcgaggtatgcccgggctgggagccgtctcctacgttgctgttgcaactgcttgaggcggcgattgctcagggcgtcgcgattccccgggcattggaatgcattggcgcatgctgcggcggcgcatgcgcgcaggtgctggggcatgtctccgccgcactgctgcgcggtgtgtgctgggatgaggcgtgggccgtgttggaacatgatggttcctccccggcttcctcggcattgggattggcatgccgcacattgcgtgccgcctgggaggatggcgtctcgccgctgccgcagattcatgcggccattgagcagatggacggcagcgaacgcgcgcggatcgagcaacgggcgtcgcgattgtcggtgcggttgctgctgcctatgggactgtgcctgctgccggcgttcctgctcatcgcggtggtgccgacgatcatgtcgttcatgcgtatgtgaggcgggtgcgcggaggttatccacattgccggcgacccgcaatgtggataacggtggagttatccacatgcgtccgtccggctttacaccgaatattggcggccgcatagtggaatcatctgggagaccagatgggaaacacaacatacaggccaacgaaacaggcaaggagagatatggaacacaatgaggtgatcctgttcgaacacaggaggcatggcgtgggtgagcgcatcaatgcggcttcggaccggctgctgcgggcgcaggtcggtttggaggcgagatggcgggcgctcatgtcccagccggaggaaggcgcggcaaccgccgaatacgcggtggtgctcgttgcggcgaccggattcgccgcggtgctggtggcgctcatgaaatccgacacggtgaagacgctgctcacgaacatcgtgaagaaagcgttgaacgtgtgaggccatgggcggccatgcattcgggcaggcgttgcgtcgcctgcagtgcgatgacgagggggcggccaccgcggaattcgcggtggtgctcccggtcatcgtgatgctggcggccttgatgctctatttgggccgggcatccgtcgtgtcggtcgggtgccaggacgcggcggccaacgccgcgcgggcgttgatggtgcaggggagcggttcgggctcgcaggccatggctcaggcggctgctggcgatggcgctcgcatagaggtgcgtcccgccggaatcgggttcgaggtgatcgcccactgcgcggtggtggccgacccctggggcatcgtgccgagaatggtgacggggcgtgcacatggcatatggcaggagaggctatgaaggaggtggccaaatgggtctgcgagggagtgcgcccaggcgagggatgagcgctgcggcgaggcgtgtgccgacgcgatccgcgccatgcattccgcatggtctgcgggcgcaggatgccggcaatgcgtcgccgagtgcggtcggcatcgtgctcgtggtggccgtgctgctgtgcaccatcgcggccggggccaggattgccatggcccgggcgcaggcgcgcaccgcagccgatatgtcggcattggccgccgccgacgcctattggaacgaggctgccgccgacccttgcggcatcggctctgccgtggcgcgcaacaatgcgggagccgtggaatcatgcgaggtgatcgacatggatgtggccatggaggtcagcaccgcaacaggcgtgccgttcgtggagcgggtgagcgcacgcgcgcgtgccggaccacggcgatgcgatgaggtcgacgcaacacgcggcgcatcgcaaccgtgatgccggggcatcattgccgagtggattttgatgcccctcacgcgctaggttatatagcacatcggtatgcggcacgagacagccatgcactgctccggcaggcatgccggccactcgggcatacgcattgcaaacagacgggatagacatggcattggcgttgtatcgcaggtataggcccgacaccttcgaaggggtgatcgggcaggaccaggttaccgtgcccctcatgcacgccttggatgagaacaagctcacccacgcatacctgttctccgggccgcgaggatgcggcaaaacgagttccgcgcgcattctggcacggtgcatcaactgtgtgaagggccccacctcgcacccgtgcggcgaatgcgacagctgcagggatctggcgaccggcggacccgggtcgatcgacgtggtggagattgacgcggcgagccacaacagcgtggacgacgcccgtgaactgcgggagagggctgggttcgccccggtgcgagaccgctacaagatcttcattctcgacgaagcgcacatggtgaccccgcagggcttcaacgcgctcctcaagatcgtggaggagccgccggagcacctcatgttcatcttcgccaccaccgagccggacaaggtgatcggcaccatccgctcacgcactcaccactacccgttccgtctggtgcctcccgagatcatgaccccgtatttggagcatgtatgcgagcaggagcacatcgagaccgagcccggtgtgctcaggctcgtcacgcgtgcgggcggcgggtcggtgcgagacacgctttcggtgctcgaccagctcatgggcggctgtgtggacaacgacatcacctacgactccaccgtggcgttgctcggtttcacgccggacgcactgctcggcgaggcgatcgacgcgatcatcgagcagaatggcgccaagctgtacggcatcattcagaaggtgatcgtggccgggttcgacgcccgcagattcgtcgaggacctgcttgtgcgcacccgcgacctgctcgtgctcacactcggcggcgatgaggccgagcatgtgctcagcgatgacgccgaggcggaagacatgagcgacctccaccggcaggccgatgcgctggggctgcaacagctcaccgccatggccgagatcatggacgacacgttggggcacatggccggagccgcctcgccgcgtatgcggctggagctgctcgccgccaagctgctggccggcagggcctcgggcttcgccgcggaggctccggcactcgccggtgcgggcgcgcgcggttcatctgctgccccttcggcgacgcagggctctgcccgcggcgggttcgtcgacgcacaacgaccctccggtttcaacgatggcgccacggcaccacagtccgggcatgacacccccacccaggccgccgctcccactgccacaccgcaagccatccaggccgccaccacggagcatgatgccggttcgcagccgcaggcagcctcgaacgtcccctcgatcccggaggacattcagcgcaacggcaccgtggatgagcgctgggacgccattgtggcggcgttgccgctggacgtgcgcgcctacatcaaccgcgagcgcgtgccacgcgtgatgctcgccatggacaggaaatccggcaggcaacgcttgtggatcaagttcgagaccccgctcgacaagtacgccttcgcactggcggtgagcaaggaaccgatcgggggcaccaccagcgtcgtctcgatagtgcgcacgcaggtgcacaacgtgttcggccccgacgtcgccttggcgcccactgagaagatggccaatggtgaatccgcccctccgctgagcaagcttccgcctgaggaggcacaacggatcaaggcgaagctgctgcagcagtcgttgcagggcatcgttgcacacccgcgcgagtcatccgattccgcccagcaggccaccacgtcggattcctccaacgatgcggaggcgcatcaagccgccggcacaaccccgacgcccactgagtcgtttcagcaagccaatggcaatggtccgcagacgttgccggacgatgacccctgggcccaaccggtgaagcccgtgggcctgcgccctcaggcattggaccccgaggagcaggcccacgaggagccgaaccggcagcagccagcgccggagcaccagcacaagcatgtggcggtgcccgacgtctccgatggcatagacccgtggagcatgccggtcgacgagcatccgcacatcgacttcggcaaggtgcagtccatcgaacagcagcacgagaggctaacacctgcgcccgtccatggcgacgacccatggagcgccatgccgaacgggcctcagggcttcggcacagcgtcccctgtgacgggcggtcaggccatgagtgtcgaggatgcctacggcatgtcaccccagggcatgcacgcggcggatgcaggatccacgggtgtggcgggtggtgaatcccagccgtccgcaccgcaggtcgatgccgatgacgacgtgtattcgatggacgacgcgcatgtgcagacgcacgacgtgatggacctcaaggccgtcgaggaatttttcgacgtgaccaaggttgagcactttgcggccgacgatgcgaacaacccgctcaacgtcaagccgcgtcgaatggaacacggcgactcgtgacgccgcgtggcatacgcttgaggagggtacatggcattggcatacgacggcgccatccagcggctcatcgactcgtttgcgagtctgccgggcatagggcccaaaggagcgcaacgcatcgccttctatctgctgcaggcgccggatgcggagtcgcagcgcctcgtcgacgcaatcaacgaggtgaaggagaaagtacggttctgcgaagtctgcgggaatgtgtgcgaaagcagcccgtgcacaatctgctcggatccgcgtcgtgatcacggcacgatctgcgtggtggaggagccgaaggacgtcatgagcatcgaacgcacgcgcgaataccgcgggctctaccaggtgctgggcggcgccatcaacccgatggccaacgtcggcccgagcgacctcaacatcgcgcagctgctcaacagactccacgacggcgaggtcaaggagatcatcgtggcgctcaatccgaacatcgagggggaggcaaccaccacctacctgagccgcctgctcgcgccgctcgacatcaaggtgacgcgtctggcgagcggtctgccggtgggcggcgacctcgagtacgccgacgaaatcacgttgtctcgcgcgctcgaagggcgtcgtgaggtgtgagcgggcgtgcgagtttcgcatcgtgagccgagaatgagacacctacaggtgcattcatacaataatcgtgcttcatgcgtacacttgagaacaaatcggcaatctcacagagggaatatcgtggctcttatcgtacagaaatacggtggctcgtcggtggccgacgccgactcgatcaaacgagtggcacgccgcatcatcgagacgaagaacgccggcaatgacgtcgccgtcgtggtctcggcgatgggagacaccaccgacgacctgatcgatcaggccatgagcatcgactcgaacccgcctgcccgtgaaatggacatgctcatgaccgcaggcgaacgcatctcgatgagcctgctcgccatggcgattcacgccgccggttcgcacgcctactcgttcaccggttcgcaggccggtttcatgaccgacgcccagttcggcgccgcccatattcgcgccgtgaaccccgaccgcgtgcgtcgcgcgctgaacaagggcagtgtcgcgatcgtggccggattccaaggccaaagcgaacgcggcgacgccaccacgctcggccgcggcggttccgacacctccgccgtcgccctggccgtcgcgctcggcgccgacgtgtgcgagatctacaccgacgtcgatggcgtgttcactgccgacccgcgcatcgtgcccaccgcgcgccgcatcccggcaatcggctacgacgagatcctcgaaatgtcgtcgtgcggctccaaggtgctcgcactgcgatgcgtggaatatgcgcagcggttcaagatgccgttgcatgtgcgcagctcgttctcgcaccgcccgggcacgctcgtgctgcccgacggcgtggacccgaacagcctgccgaacgtgcggtaatacggaatctgcaagcagattattcaatacaatacgagtttttatataaaaatcggagtatggagacagacaatgagcgacaataccgatcagtctttgggtgacctcttcccagaccttggtcaggaaacgccgattatttcgggcgtggcgcacgacaacagcgaatccctcgtcaccgtgcgcggcgtgaccgacgaaccgggcatggccggtagggtgttcacacgcctcgccgagctcggtgtgaacgtcgacatgatcgttcaggcgggcgcctccaccggcaccgccgacatctccttcaccatccccggctccgacgccgcccgagtggagacggcgctcaccgccgcgcaagacacgttgggctacaagtcgttcgacgtcaatccgaacgtgggcaaggtggccgtcgtgggcgtcggcatgaaaacgcattccggtctcgctgcccgcttcttccaggcactgagcgaggagggcatcaacgtgctcatgatctccacctccgagatccgcatcgccgccctcgtgccgctctcgcagctcaacgacgccgtgcgcgccctgcatagcgcgtacggtctggacgccgacaaggttgaggccgttgtctatggcggcaccggccgctgagcggaatctgcaaactcacaacaaggtattcggcggcagccggaaaaggagccgaaatggtacagatcaacgatcgtggcgtcaatgtggcagtattgggcgcaaccggccaggtgggcatggtgatgcgccgcgtgctcgacgagcgcgacttcccggtgaaagacctgcgattcctcgcctccgcgcattccgcgggcaaggtgctcaactggcgtgggcacgacatcacggtggaggatgtcgcgaccgccgacctgagcggcatcgacatcgcgatcttctcggcgggcggcggcacctccaaggtgtgggcgccgaagttcgccgaagcgggcgcctacgtgatcgacaactcctcgcagtggcgcatgcacgacgacgtgccgctggtcgtggctgaggtgaatccggacgatctcgacgagatcccgaccggcattgtggccaacccgaactgcacgaccatggccatcatgccggtgctcaagccgctcgccgacaagttcggcctgaagcgcctcatcgtgagctcctaccaggcggtgtcgggcgcgggccgcgcgggtgtggagcagctgatgaacgaagccaaggcagccgttgaccagggcgccgacaagctcgtgttcggcggcgacgccatcgacttcccggaacccaccaaggtggcgcgcaccatcgcgttcaacgaggtgccgttcatcggcgacattgtggatgacggctcccaggagaccgacgaggagcagaaactgcgcaacgaaagccgtaagatcctgcatctgcccgatctcaaggcatcctgcacctgcgtgcgtgtgggcgtgttcaccgcacacggcatgagcgtcaacgccgagttcgaaaacccggtgagcgtcgaggaagccaaggaggtgctcgcgagcgcccccgccgtggaactcaccgacatccccaccgcgcagctcgccgccggcaagacgccgagcttcgtcggccgcatccgcgtggaccaggccgtcgacgacaataagggcctcgcgttcttcgtcaccaacgacaatctgcgcaagggagccgcgctcaacgccgtcgagctcgccgagatcgtcgcgcgcaagcatttcgcagaccagctctgagacatcccgtaacagtttcagcaccccgagaaacaatgacatcccgtaacggtcggtcataccggactggcccttacgggatgtcattgttcgttcttacgggatgtcattgttcttacgggctagggttttgcttacgggctaggcttcgcacatggatgtggctaagctgggaagcatgtcaatggcatcgatcgaagcgaacaaacagctggaacgactcgtggcgctcggctacccggacgtggccgacatgagcgaagacgccttccgcgcactggcacgcccgctcatccgcgcacttgagcgcagcgatctgggcgccgatatactgctcgtgcccacacgcgaactcgtcactccggaatcgctgatcgcgcgcaccagcatagatcgcatggccggcttcaccaccatgccgccgcgcgacatagtcagcttcctgcccaccgacggattcgaaccgccggaaggcccgttctatctggtcatcgaaccgcacaccggcacctgttatacgaaccgcgagcccgacgtggcgcgcaagctcatcgaatccgacgaacgtctgccgctcacgcttgaagagggtctcgccatcgccacgcagcatccggaatggctgcttgagaagaacggattcaatctgctgggctcgcgcagtgccgacgggcgcgtgccgagcatctggatgagccagagcgcccctcgactcggcgccgtctggccgaactcgcgccacacctggctcggcaatgcatactgcatcgcgcgccgcggtgtgagtctcatcgaagggcgcggctgagcgcggcgtattttgaggaagtctccgtgcgttgcgttgcggagagatccagggatggcatattttacggagacttccgtgcgccgtgctgtttttggtagcttctgcggtcagattctcggatgcttccgtatacgatgccattttcagatgcctttgtggcatgttttacggaagcttccgtgagatatgccggagaggggccccggaatggcatagttttcggaagtctccgtacgttgtgccgtggcagtgtggtttggtggtctgtctttcggaagcctccgtgagatgtgccgcggagaagtctgcaaacggcagattccacggaaccttccgtaaaccgtgccacagtccgcaaacttgtgccgcagggagtgccgcgcagtgccgcgcagcacagcgcggcgcgaattgtatgcaatgtttgtaaaatccctgcttgggatggccgaaatacggactgtcgcaagcccctttcttgctagcgcgtatatggttattgtttacgcgcgtgtgcgcgtcacgaaatctgaaaattttgcactctcgaaggaggagaagatgggtcagggtcaatcttcggtgtttgatctcgctgccgttgccgcggcatccaatggggggaacaatgacccgctgctgcctccggcacggtacattggcgccccgcagaagccgagcgatatgccgtacaccaagtatgtggcatacgacaagcaggtgccattcgactacccggagcgcacatggccgggcaagcggctgcacagggcgccgcgctggtgctcggtggatctgcgcgacggcaaccaggcactcgtgaacccgatggattccgagcgcaagctgcggttctggaccatgctcgtcgacatgggattcaaggagatcgaagtcggcttcccgagcgcttcggagaccgattacgacttcattcgcttgctcatcgagcgcgagctcattcccgacgacgtgacaatcgtcgtgctcacgcaggcccgtgagcacctcattcgcaagacttacgaatgcctgcgcggttgcaagcgcgccattgtacacttctacaactccgtctccgtgctgcagcgcgaggtcgtgttccgcaaagaccgcgcgggcatcaagaagctcgccaccgatgccgcgcacctgtgcaaggaactcgagggcgacgccgagggcatcgacctgtactacgagtattcgccggaatcgttcactggaaccgagccggagtacgcggtggaggtgtgcaatgcggtgatcgacgtgatcaagccgacgcccgggcatccgatgatcatcaatctgcccgcgacggtggagatgaccacgccgaacgtgttcgcagacgaagtggagtacgtttccaataatctgcgcgaccgcgatgccgtggtgctctcgctccacccgcacaacgacgagggcatgggcgtcgccgctgccgaactcggtatgctcgccggcgcggaccgcatcgaaggctgcctgctcggcaacggcgagcgcaccggcaacgtcgatctcgtcacgctgggcctgaatctgctcacgcagggcattgacccacagctcgatctctccgacatgccgggcattcgcaagaccgtcgaatactgcaatcagatcaagatctccgagcgccacccgtatgccggcaacttcgtgttcaccgcgttctccggctcgcaccaggacgcgatcaagaaggggctcgaagcgcgtgagatcgccgcggagatggccggcgtggacgtggagaacttcgtgtggctcgtgccctacctgccgatcgacccgaaggacatcggccgttcgtacgaggcgatcattcgcgtgaactcgcagtcaggcaagggcggcatggcctacctgctcaaggcgaatcacaatctcgacctgccgaagaagctgcaggtggaattcgagaaggtggtgcagcagcatgccgacgccacgaagaaggaagtcaaggacggcgacatctggcatctgttcaaagacgagtacttgcccgtcgaggaatccggcgcgatcgaggccggcgaggtggtcgccgacacgcatgacgagacgctcgaccagtggggccgtctcaagctgctcaaggtgagcatgtcgtcgggtgaggacggttccgacacgcgcctgaccgccaccgtgctcgaccgcggcatcaacgtgggccgcgagcccgaggtgacgcgcgagatcgagggcaccggcaacggcccgatcgccgcgttcctcgacgcgctcaagagcttcggcgtcgtggcgtccgtgctcgattacgcggagcatacgatgggcgtcggctcggacgcgcgcgccgcctcctacgtgcagtgcgaggtcggccaggaagacgaggagaagcgcgtcgtgtggggcgtgggcatcgactcgtcgatcatcacgagctcgctcaaggcgatcatctcggcgatcaaccgctccaaccgctgacgttgcggcgctgccgttgcgttgatgctgcactggcggccggcaggcgaatacgccatgccggccgtcggcatgtgagtaataggcatgcgagcctatgcgaaagccgcgggtgttgtgcccgcggctttcgcataggtggctccgctatcgctgcgtctgctcgccgtttccggtgttattctggctgccgttgttgccgccggtgttgccgttctgattgccggagttcccggaatcgccggaattcgaaccactgttgttgctgccgttgttgctgccgttgttgctgccgttgttgccgccgttgttgccgctggtgttgccgttctgattgccggagttcccggaatcgccggaattcgaaccgccgttgttgtcactggggttgccgccggtttcacccccgccattgccgttggtgttgtcgttcccgggttgcggctgctccggggtcttcgtgttctcgggtgcggtctgctgctgctcgttctgctgctgttgctgcgtgccattgttcgtgctcggcacgtaccgctggccgcccagaccccagtcgccgttcgggccgccaatcttgccgttgtcgaccggcgtcgcgaaggtctccgccggctgcccggcgagcgcctgcgccatgaactcggtgaacagatgcgacgggtagccggtcgagctcacgccgtagcccgcgaattccggcacgatctgcgattcgccgttctcacccggattccagattgcccacacgttcatcagcgacggcgtgtagcccacgaaggaggccgccgtctcgtcgttcgccgtgcccgacttgccggcgacctgacggccgagcctcgccgccgtgcccgccgcggtgccgtattgcgtggtgccgagcatcgcgttctgcacgagctggcagtcgttcgcgtcgaacacctgcttcgtgccgaggtccggcttgtacatctccttgtcgcccttgagcacgcggtcgacaatgtgcagcgtgttcttcgtgccgtcgttcgcgatcgtcgagtgcccctgcgcgaggtcccacacggtgagcgagttgatgccgaggatgttgtagagcgtgtcttcctgaatgtcgccgctgatgcccgcatcatgcgcgatctgggcgaatttcttcggcgtcagatgctggttcacgttcatgaacaccgtgttcaccgagttcgcggtcgcctgcttgaggttgatcgtgccccagctcatgttgagcgcgttcggcacctctgcccacgtgcccggcgtcgtttcgaagcgttcgggcgaattgccgttgaacatcgtgttgaagttcacgtcgtccattgctgcgccgagcagaccgaagggcttcatggtggagcccggctggaagttcgcctgcgtggcgttgttgagctggtgcttgaggtagtcgctgccgccgtagatcgccttcaccgagccggtcttctggtcgagcgcgatgccgcccacctgaatgctctccggcatgccttccggccggtcatctcccaccgtctgcatgatcttctgcatgttcgggtcgagcgtgctcacgatcttgtatccgccggtctcgagctcgtctttggtgaacgccttgctcgccacgagctcgttctccacggtggtgagcaggtagccgttcggcccggccaggtcgttgctcaccgacactggcttcgtctcggggaacttcgcctcgctggcctgttggccggtgatgtagccgtcttcgcgcatgatgccgatcacgcgcgtgaatctgctcttggcctgcgcctcgttcaccgccgggtcccacatgctcggtgccgggatgatgccggcgatcatcgccgcctcgtccacggtgaggtctttcgcctccttgccgaagtacgctttcgccgccgcctgtatgccgtatgcgccgcggcccaggtagatcgtgttcatgtagttgcacagcacctgctgcttgtcctgcgaattcgcgatcttcatcgcgagtatggcctcgcgaatcttgcccgaatacgaggtggtgtcgcccagataataccgttccgcatactgctgcgtgatcgtggagccgccctgccgcgatcccgtggtcagattgttgtacagagcgcgcgccatgcccatgatgtcaatgccgccgttgcggtagaacgagcggtcttcggaggcgacgatcgcgttgcccacgtagtccggcagcacggagcaatctatgatctcgcggttctgctcggagaacgagccgatctcggtggtgccgtcgttgtagtagaccgtggtcttctcggcgatggcgaccttctccggctgcggaatgtcggtggtcacatacaggtaggtgaacaggccgatgccaatcgccagcagaccgccgagcacgccgagcagaatcttccaccagagtccctttttgcggttcgtgcgcttcttcgggcctttcggggcgttctgcccgcgcttgggcgcgcggtgcgacgtggacgccttgtgcgcggcgcgcggcgagcttgagcttgagctgacggtacgtgcttggtagaccatgcgttccacggtagtcaaagaccctgaaaaaactcaagattgcgggaggaatctgcacaagccaacccgcggtgtgcggttttgagatgccggccgggcaacagattgcatggcgggtgtctggctggcgaggaactgtaatctgagcgcgaacttacgaaagcgtagctttggcgacgttttccagcatgccgactatcttcggtatatatctctcgaattgcatcgtggggataagaaggtatgcttaaaggcggaaaatcgctcacgagtaacacagattattagaggagtcgtttcaatgagcattcgcgtggctattgccggtgtgggtaattgcgcctcgtcactggtgcagggtgtcgagtattacaaggacaccaaggacgaagacaagattcccggcctcatgcacaacaatttcggcggataccgcgttcgcgacatcgaattcgtgaccgccttcgacgttgatgccgacaaggttggcaaggacctctccgaagcgatcggcgcctcgcagaacaacacgatcaagttcgcggatgtcccgaacctcggcgtcgaggtgctgcgtggaccgacccacgacggtctcggcgaatactaccgcgagatgatcaccgagagcgacgaggagccggtggacgtggcccaggtgctgcgcgacaagaaggtcgacgtactcgtctcctacctgccggtgggttccgaggaggccgacaaggcctacgcccaggccgccatggatgcgggcgtggccttcgtcaactgcctgcccgtgttcatcgcctccgaccctgagtgggcccagaagttccgcgatgccggcgtgccgatcatcggcgacgacatcaagagccaggtcggcgccacgatcacgcaccgtgtgctcgcccgcctgttcgaagaccgtggtgtgcgtctcgaccgcacctaccagctcaatgtgggcggcaacatggacttcatgaacatgctgcagcgttcgcgcctcgagtccaagaagatctcgaagacgcgcgccgtcacctccgtggtgccccatgagatggatccgcacaacgtgcacatcggtccgtccgactatgtggcctggctcgacgatcgcaagttcgcattcgtgcgcctcgagggcacgaccttcggcgatgtcccgctgagcctcgaatacaagctgcaggtgtgggattcgccgaactccgccggcatcgtgatcgacgccgtgcgcgccgccaagatcgccctcgaccgcggtctggccggcccggtgctcgcgccgtcctcctacttcatgaagtccccggccgtccagcatgaggacaccgaggcccgtcagctcgtcgaagccttcatcaagggcgacgtcgaagccaacgaggaggagctcaacgccgatgtcgcagccgccaaggccgccggcaaggacgtgtggaaggcctgattcggcttcctgtggcctatgcaaccgtggaaagggtgacgcctacgcgtcacccttttgttttccctacaattctccttcttcttcttcttctcctcctcctcctttgcgctcctttgcgtaatttgggacatctgcgggcctccatctgtccctttttacgcagacggatttacgcagacggatttacgcagacgggtgcggacgtacacgttgggttggcattggggcaggggtggtgtacactggcttacgcctccgcgtggcactatgtcacccaatccccccagggcaggaatgcagcaagggtaagtggcctctggtgggtgcgcggaggtttttcatatccgctcatatctgctcactgttcagttctgcacgtatcgtgaatagcatgagcgagcacgacgagacgaacaccaatgcacagcgcgcgccgcactccgcgtcacccgcgccatccgcacccacacactccactcccgcagacgacacacagtggagcgtgctgcaggagcgtgcggaagtgcgcgaagacaatctggactcgcagacccaggacccgcgtatcgccgcacagattgacgccgcccgcgcgcgtggcttcgtgccgctgtctgaaagcgaaagcgagcgcacggccaagaattcgccggaggatctgcaagcccaaatcgaagccgggctcacgcaggtcgatccgctcatggtccgcccgcgcatctcgagccgcatcctgtgtggggtgatcgcgctcgtgttcgcactgctcgcgttcggctcgtatcggctcggtgtgcacacgctcaaaggccaaggctatgaagacctcgtcatcggcaatttcgcgaactacacgccgcagtggctgctcaggcataatctgggactcaccgattccgtggtcgtgatcagcgtgagcatctcgctcggcgccatcgccgtgttcgtcgcgctgttgcggcgccgttggtggctcgctggccagctcgtcgcattcgccgccgtgagtttcgcctgcgcgcgcgtgctcaaaccggcactccctcggccactgcttatgcagattcattcgtccaccgcgaactccgcgcccagcggacacacgatgctcgccatcaccgccggactcatgctcgtctgcgcggtgccccgggcgtggcgcgccgcctgcgccctgttcgccgccgcctactccatgctcgtgggcgtctttgtgatcgcagacaaatggcaccgcccctgcgacgtgctcatggccgtgttcctggtgggcgcgctcgcgatgctcatgttgctgttcacgcgcaggagcggcatggaccgccccggcaagcgcgtctcgtccgccagcgtgcagattgcctcaaccgtgctcatcacgctcggcatctgcggtttcgcctacgccggctacatcatctggcagattttccccggactcgaatacggcgtcgcctggtcgacgggcggcgcgtgcatgtccgccggcgtgctcgtgatcgcggtgaacgcgctcgtcgtcggcgctgtgctggccgtgcgccagctcactgcgtcgccgctcacacgtctgggccagatcggcgccccgcccgcgcctccgcgccgctgattgcgcggtgccgccgtccttgtgccgtgccgccctaccgcccctattgcttacgggatgtcgtcatctcttatgggatgtcactatctgctacgggatgtctgcactcaagtggacttgttcgaaaatgacagtaattttgttgttaattcccttagtaatcagcaaaatgtgttatttttgataatctacttttcattccaaaggaaataaaacatcccgtagcagagggaaggtgtgagggccatatggggcgcaatagctcgaaaacacgctccgcgcgcaaaagttgtgtggaacgtgagtagtatgtggactcgtcagggaaagtaaggagagcgatcatgaccaccggcagcaagctcgtcatagtggagtctcccgccaaggcgaagaagatcggcgggtatctcggggacggctacaccgttctggcgtcggtgggccatattcgcgacctcgcacagccaagccaggtgccggcggacgagaaggcgaagttcggcaagttcggcgtggatgtgaacgacgggttcaagccgtactatatagtcggcccggagaagaagaagaccgtctccgaactgcgttccgcgctgcgcaatgccagcgagctctacctcgccaccgacgaggatcgcgaaggcgaggcgatcgcatggcatctcgtgcagacgctcaagccgaaggttccggtcaagcgcatggtgttccacgagatcacgccggaggcgatccgcgcgtcgctcgaacacacgcgcgaagtggacaacaacatggtcgacgcacaggagacccgccgcgtgctcgaccgcctgtacggctatgagctgtcgccggtgctgtggcgcaaggtggggccgggcctgtccgccggccgtgtgcagtcggtggccacgcgcctcattgtggagcgcgaacgcgagcgtatggcgttcgtgcgcgcgccgtactgggatgtcgtcgccacgctgtgcgccccggacgcgctcggcgagccgaccgatttcgaatcgcgcatgattgcgctcaatggcactcgtctggccacgtccaaggatttcaagtcggacggcacgctcaccgacgccgcgcgcacggatggcgtggtgcagctgggcgaatcgcaggccggtgaccttgccgacgcgctcgccgacgcccgcttccgcgtgatctcggtggagaagaagccgtatcgcaggcgcccgcagccgccgttcaccacgtcgaccatgcagcaggccgccggcaacagactcggcatgagctcacggcagacgatgcgcgcggcccagagtctgtacgagaacgggtacatcacctatatgcgcaccgactcggtgacgctgtcgcatgaggcgatcgaagcggcgcgcgagagcgtgtcgaagaacttcggctcacagtacctttccgaaaagcccaagcagtatgcgacgaagaccgcgggcgcgcaggaggcgcacgagtgcattcgccccgccggctcgcacttccgcgatccctcgcagctcgccacgttgccgcccgatcagctcaagctgtacacgctgatctggcagcgcacgctcgcctcgcagatggccgatgccaccggttccaccgccaccgcgcgctttgcggcatctgcgggcggactcggcgaggcgacgttccagtcgtcgggcacggtgatcgaattccccggcttcatgcgcgtgaccggcgagcgcggcggctcgggcaagaagggcgaggagagcgcgtcgctgccgccgctcgccgagagcgccgaactgccggcgaagagcgtgcttgcagacggccatgagacgcagccgccggcacgctacaccgaagcgtcgcttgtgaagaccttggaggccaaggagatcggccgtccgtcgacgtacgcgaacatcatctcgacgatcatcgaccgcgggtatgtgtacgagcgcgggcgtgcgctgatccccagctggctcgccttcgccgtgaccaggctgctcgagacgaagttccccaagtacgtggactaccagttcaccgcagatatggagaacggtctcgaccagatcgcgcacggcaatgagaccggtcgcgaatggctcacccagttctatttcggttcgggcgcggattctgcccgttcggccgacgaggcacatgagggcctgcaacgtcaggtcgcgcagctcggcgagatcgacgcccgtgagatcaacacgattccgatcggcgacggcatccatgtgcgcgtggggcgctatggcccatatttggaagacacgaaggatctggacgccgaaggcaatccgaagcgcgcctcgattcccgacaccatcgcccccgacgagctcacggtgggcgaggcacgcaagctcatcgccagcaatgcgggcggtccgcgtgtgctgggcaccgatccggccaccggaggcaccgttgaggtgcgcaacggcagattcggtccgtatgtggcgttggtggcgccggaatctgcacacgaaagcgccccgaccggcaagaagaaggccgcggagccgaagccgaagatggcgtcgctgttcaagagcatgaagccggagacggtcacgctcgacgacgcgctgcgtctgctgagcctgccgcgcaccgtgtgcacgtatgacgaggtggatgcgaagaccggtgagacggtctcggtcacgatcagcgcgagcaacggccgctacggcccgtacctgacgaagacgcgcgcggacggcggcgcttcggaaacgcgttcgctcgagtctgaagatgcgatcttcaccgttgacgagacccatgcgcaggcattgttcgcgcagccgaagtacggtcgtgggcgcggtgccgcgaagccgccgctgcgcacgctcgggcccgacccggagtcgaagcgcgaggtgagcatcaaggaaggattctacggcgcgtacatcaccgacggcgagacgaaccgctcgctgcccaagcagtacgatccgaagaccatctccgccgaggacgcgttccgcctgctcgccgagaagcgcgccgccgggccgagcaagaggcgtggccgcaagggcaaggccagcgcgaaatcgacggggaagggcacggcgaagggcaggaagtccgcgccgaagaagtccgccactgagacagcccgcgacaggcgccgcaagcaggtgcgcgagctggccgagcagggctgggcgaacacgcgcatcgcgaaggagatcggctcctcggccgccacggtgaaggccgacgtggagtatttggaggcgaacgaaggcttcaagcggccgcccgtcgtcccagccaagtagccataggcgtccctggcccgtggggatggcgcatttattccttacgggatgtcggcaaccctgacgcatcctttgcgccggtgtcgtctgaagtttaatccttacgggatgtcgtcaactcttacgggatgtcagttttttgaccccttaccctttgaacgacaagagcaatggccattttccaaggtttgatgcctcgaatactttggccgtgacatcccgtaagcattgacgacatcccgtaagagttggtgacatcccgtacgcactgttatctcttacgggatgtcgtcagctgctacgggatgtcaccaactgctacgggatgtctctccctgttacgggccagcttgttacgggccagcctgctgcgggctaggacaccccttacgggccaagatgtctcttacgggccggcagtttctgttacgggctagggccaacctctctatttgggatatagactgttgaacaatggcggttttgtgtaaccgatacgggcgtaccccgctcattttccctagcccgtaacagaaactgccggcccgtaagcaaattgctggcccgtaagggcggtggtagcccgtaacggatagtctggcccgtagcagctatcagggtagcaggtatcaaaataagcaggcaccagcgtggcagatgccagcgttagatagggagaggcgatgggcgcaggactgttcatttcgttcgaaggcgtggacggcgccggcaagacgacgcaggtgaatctgctcgcggactatctgcgtgcgctcggccgcgaggtggttgtcacgcgcgagccgggcggcaccgcgctcggcacgcagatccgcgccatgctgctcaccacgaatcccgacgaggagatctccccgcgcaccgaggcgctgctgttcgccgccgaccgcgcccagcacgtgagcgaggtcatccgcccggcactcgagcgcggtgccgtcgtcatcaccgaccgttacctcgactcctcgctcgcctaccagtccggtggccgcgagctcaccgccgacgacattcgaaccttaagcatgtgggccacgaacaatctgctgcccgcgcgcacctacttgctcgacatcgacccgcgcgcctcgcacacgcgcctcgagcacgccgaagaccgcatggaatccgccggcgacgacttccagcagcgcacgcgcacggcgttcctcgagctcgcggccgtgcagccgcaacgcttctgcgtgatcgacgcacagcagtccgtgggggaaatcgccgcgctgatttgcgacgacgtcgcgaatctgcttgagtaacacctatgagtgtgtgggatgcaatcgtagggcagccgaaggttgtcgaggaactcaggcgcgtcgccgagggtgacgggcgcggcgtggcgcagtcgtggctgatctgcgggccggccggctcgggcaccatgcaggtcgcgcgcgcgttcgccgccgcgttggagagccccgaccacggcgagggcgagctgccgacgaagatcacctcgcagattctcgcagaccgcttccccgacgtcgtcacactctccaccgacaaggtgacgatcggcatcgacgaggtgcgtgatctggtcacgctcagcgagcagatgccgagcaccgcgccttggcgaatcatcatcatcgagaacaccgaacgcatgctcgagcgcacgacgaacgtgctgctcaaggagatcgaggagccctccgcgcacacgatctggctgctgtgtgcgccgagcgcgcaggatgtgctgcccacgatccgctcgcgcacgcggctcgtcacgcttggcgtgccggtggccgacgagatcgcgacctggctggaacgcgaggtgcgcgtgctcgaagacccgacgaagcgcgagcgcgcgcgggcgaaggcggtcggcggccgggctggcgcgaaggcggcgcgctccggcaaatccgcgaaggcgcccaagccggctcccgctcccgaaccgcgccctgtttcacatgaaacggcagtgcgcattgcgcggctgtgcgaggggaatctcgacatcgcgcggctttacgcgcgatacccgagcgtgctgcgctcgcgcgaccagcttgtgaacaacgtgctgaagatgacccgcgcatcgcaggcggtcgtcttcgcgggcgaactgtatgggtccgcgcaggagcaggcgaacgaacgcgccgagcaggcggctggggagcggcaggcggagtttcgcaaactcaacggactctcgcccgacgagacggttcccgccgatcttcgccgcgcatacaccgcgctcgccaagaaagacgacatcaagcggcatgccacgcgcatgacccgcgatgtgctcgaccgcgcgttcaccacgatcgccagcatctaccgcgacgtcgccgtgtttcagaacgacgccgaggggtcggtggggctcatcaacatcgagaaccgcgacgccatagccgagctgtccgcgcagctcacccgcgagcagaccctcgcgcgcatggacgccatctccaccgcacgccggcgcatcgcgggcaacggcaatgcgctgctcgacatcgaagcgctgttctgcgcgctgcttcccgaacgtcgctagcgtactgcgttatgggaatggcatggcgttcggaggcttccgtggaaaccgccaatctgtaatctggaaatggcagtttacgcggaaatgtctgcgcaaactgccgttcaatgcgcgcgtgctcggcgtgaacaagaaacgcacgggcgacacggtgcgcgatactggaactatgttagtttccgcagatttcaacaccatccccgaacagtatgccaagaacgcgcccgatgacgcgcgcgtggacggcgtgccctgcgtctcgttcccgttctacatcgaccatctcaacccggccgccaagtatttgcactgggaattcagcgacccggattccattccggtatgcggattcgaatggatccactggaccatggcgaatctgccggtcgccgcgctcatgttcgacccgtccgacgcgcacgccttgcagattccgccggatttctcgcgccgcgtcaccgcgatgatcccggaggccgtgcagggccgcaattcgcaggcgtcgccgctgtacgggcaggatcagcggaatctgcagctcgtcgcacactacaccggcccgcagccaccggacaaggaccacggttatgtactgcagatctggggcaccacctcgccgatcgccggactcgaacagggcttctggctcaacgagatgctgcacggcctcgagcattcgcaggtcgtcgacggcggcggcatcacgctgatcggcaagtgctgagctctgcctcgcagtccgtttttcggaagcatccgtgcgttatgccgcagtgaggtccctctgcggtctgttttgcggagttttccgtatgctgtgccgcggtgggtcagtttcttggtcgttctttcggaagcttccgtgtaacggtacgcgggagtggcattccgcggttcgtttttcggatgcttccgtatgactgaccgcagattagctgattggcggtccgccttacggatgcttccgtatgccaggccatgggggagtcaatctgtggcgtatctttcggaaccttccgtgtaatcgaccgcagaagtgctgcctggcggcatgtcttgcggaagcatccgcgcgattgaccgcggagggggcgatttgcggcccagctttcggaaccttccgcgtaacagaccgcggggagggcaatctgcggcatatttcacggaagcttccgtaaaacgggccgcagatatgtcgtgcagtggttcgtttcacggagtcttccgtataacaggccgtgaatggggcgatctgcaaaccacataggcgcccgcatattcgcccacatatccacctacggaataattggccgcccagcactgccggtgcgcggcaaagcgcggtagaacactaaaggagcgaagagaaaccaattcgtgaaatcgaggaagcaaaatggcatgcactacaattctggtgggccgcggcgcgagttatgacgggtcgacgatcatcgcgcgcaatgaagacgacgagcccggctcgttcaacaacaagaagctcatcatcgtgcggcctgaagaccagccgcgcacctacacaagcgtgaacggtcacctgacgatcgagctgcccgacgatccgctgcagtattccgagaccccgaattcgttcacgagcgacggcgtgtggggcgaggccggtatcaacgaggcgaacgtggcgatgacggccaccgagacgatcacgtcgaacgcgcgcgcgctcggcgcagacccgctcgtgccgtacacgccggcgatcggcaagcccggcgacgcgaattacgtgcccgcagtggccggcggcattggcgaggaggatctcgtcacaatcgtgctgccgtacattcacaccgctcgcgagggcgtggagcgcttgggctcgctgctcgaggaatatggcacgtacgaaagcaacggcattggcttctccgattcgcatgaggtgtggtggatcgagacggtgggcggtcatcattggatcgcgcgccgcgtgccggatgactgctacgtggtgaatccgaaccgcctgggcatcgacgagttcgatttcgaagatgcgttcggcgagcagcgcgactacatgtgctccgccgatctgcgcgaattcatgcgcatgcatcacctcgacgtcgactatgcgctcgaaggccagttcgacccgcgcgacgcgttcggctcgcactccgacatggaccatgtgtacaacacaccgcgcgcgtggatgatcgagcgctacttcaatccgctcgacgagacgtgggagggcccggacgctgacctgacgccatccagcgacgacattccgtggtgccgccagcccgaccacaagattacgatcgaagacgtcgactacgcgctcgccatgcactaccagggcacgaagttcgacccgtacggcaagctcggcaccgaggcgacccgtcacctgtatcgtcctgccggcatcaaccgcacctgcgaacgctcgatcatgcagattcgcccgtacgctccacaagccgatcgcgcaatccactggatcacgttcgccgccaccccgttcaatgccaccgtgccgttcttcgcgaacgtcgacgcgatgccggactacgtgagcaacacgacgccggaggtcacgctcgacagttattactgggcgagcagattcctcgccgtgctgggtgactcggattactccggcaccgccgagccgatcgcccactacaagcagaccgttgccgcgcttgggcatcagatggtcttcgccaccgacgagcagctcgcccgtctcggtggcaaagacacgcgcgacgccgccgcccgcgaacgcgaggacgagcaggaggcgctgcccgccgacgtggagccgatgaagcccgcagacgtggtgaaggccacgcgcgatgagaagacccgcgaggtgctggccgccgccaacgagaacatggccaagcagctcaaggcccagacccagacgattctcgcccagtgcctgcaggccacgagcgtgaacatgaaggacgccttcagcatggccgacttctaaatcggtctgctcccaacaatccagcccaacctatggcctctttccggcatcaaaggctgggctgtttcttattccttctcactattccatattcttattccttacgggatgtctttattccctacgggatgttttctttctctcgtaatatattaaaatgctcaaaatctatcaaaatggcgcatgcggctcggtgcattacgacaaaaataacgtcattgcgaacattttcacacaggtctacttggggcaagacatcccgtaagaaataacgacatcccgtaaggggttaagagaggccggggagggttaagaaaggccggggaggggttaagagaagctggggcctcaaaaatgccctagagagccgggggtgagaatgcggggctgacgaatcgccgaggaactgcgacaatctcagcatatgaacttcgcatatcgcatcatgggtggtgcatgtgtggagaatctgtaaacttctacaatgttcgaaaaacaacagacgagctgaggagaatcatgggctgcaccacactgctagtaggcagagacgcgagttacgacgggtcgacgatcatcgcgcgcaatgaagacagctgcaacggcgaattcgacccgaagcagttcatcattgtgaagccgcaggaccagccgcgcaattaccgcgcggtgatctcgcatgtgcagatcgagctgcccgatgatccgctgcaatattcgagtgtgccgaacgcggaccgcaagcaggggatctggggcgaagccggcgtgaacgaagcgaacgtggcgatgagcgccaccgagacgctcacgacgaacgagcgcgtgctcggtgccgacccgctcgtcgagtatgtgccagcgcaaggcaagccgggcgacgcggactacgagcctgaggtcgccggcggcattggcgaggaggacttcctcaccatcgtgctgccgtatgtcaagaccgcgcgcgagggcgtcgcacgcctgggcgcgctgctcgaggagtatggcacgtacgagatgaacggcgtcgcattcagcgatgcgaacgagatctggtggctcgagacagtaggcggccaccactggatcgcacgccgcgtgccagatgactgctacgtgacgatgccgaatcagctcggcattgacgagttcgacgtcgaagacggcatcggcgagcaggtcaactacatgtgcagtgccgacatgcgcgacttcatcgagcggaatcatctcgatctcgcggtggaggggtccatgccgttctcgccgcgcgacgcgttcggctcgcactccgactccgaccatgtgtacaacacgccgcgcgcgtggtatatgcagcgctatttcaatccgttcgacgaggtgtgggacggcccggacgccgaccacaagccgaattccgacgacattccgtggtgccgtcagcccgaccgcaagatctcgatggaagatgtgaagtacattctgagctcacactaccaggagaccccgttcgacccgtacggttcgctcggtgacgcggcgtcgcgcacgcgcttccgcccgatcggcatcaatcgcacgaatcatctggccgtcatgcagattcgcccgtaccgcccgcaggtcaaccgcgcggtgcagtggcttgcctatggttcgaatccgttcaacgcgatggtcccgttcttcccgaacgtcgacgacacgcccgcctacctgcgcgacacgaccacgcgcgtgacctccgagaatttctactgggcgaacagattgatcggcgtgctgtgcgacgcgcagttcgccgagaccgcgaacgccgtggagacctaccagcagaaagtcggcgcgcttggccatgccatggtgcgtgctgccgacgagcaggtgaatagattgggcggcacagccgtgctcgaggccgcgtcccgtgagcgcgaggccaacgccgagttcgccgaagacgagctcgtggaagacgtgcagccgatgagcccggatgagatcatcaccgccgtgcgcaacccggaggtgcgcgaggtgctggccacggcgaacgacgatttggcgcgcaaactcaagaaggagaccgagaagctgctcgactccgcgctgttcacgtcgagcctcgcgatgaagaaccacttcgcgatgtccgacaactgatcctctcctgcgccatccctcccgctcgcctcccaaccccacggcagtcgtgaggttgggaggcgagcggccccggagaacgctttggtgtggcgctttccgctttggtgtgacggtgccttccagagagccgaactgcgaatggcggaattccgccatttcggaatgcgggcagctcggccgaccgtcacaccaaagcaaaaaacgtcacaccaaagcagattcatgcacaagggaaatgcgattcgtgcagattgccgagtagtcatcatgcaaattgccgagtatactgtatgcatattgccgaatatgattcgtgtaaattgctgagtgggcgccgggaggttgacatgccgttgattccacgtgaactggagccgatgctgctcgaacgagcccgagcctaccctgcggtgacgctcactggtccgaggcaaagcgggaagtcgacattggtgcgggaagcctttcccgactacgactacgtttccttggaagacatcgatatgcgtgaattggcgcacgacgacccgcgcagcttcctgcagcgttactcgaaccatgtgattctcgacgaggtacagcgcgtgcctgagctcttctcgtacatgcaacgcgtaatggacgagcgcaatgagcccgggcagttcattctttccggatcgcagaacttcctgctgctcaatagcatctcacagtccctggcgggtcgtgtggccattctgcatctgcttccgctttcttacacggagctgacgcacgctggcgaaaccccgtccaacgacgagttcgtattccgtggcggatacccgcgtctttactcctcgttggctacgccggcagatttctaccccggctatgtcgccacatacattgaccgcgatgtgcgtgctgagctcggcgtgaagaaaatagactccttcaacagattccttacgctcgccgcacttcgtataggtgaggtgatgaacgtgtctcaccttgccgacgaagccgatgtggacagcgccaccattcgcaactggctttccatactcaacgcgagcttcatcgctttccaactgcagccgtactaccgcaactatggcaaacgactggtgaaatctgcgaaactgtatttctatgacaccggtttggcggcgaatctgcttggcattgagagcgcggaccagctgttcgcgagccagtgtcgcggggcgttgttcgagaacgcggttgtgctcgaaatagtcaagcaataccaggcgcaggggaaggagccgaaactctattattggcgtgacagcggccaaaaagaggtcgacctcattattgagcgtggggggaatccctatttcgtgatcgagatcaaatcgtcggccacgtaccgtccgaagtatttcgaaacgctggatgacatcgcagaggcgatgggtgtgcccacggagcgccgtttcgtggtgtatggcggcgaggagacgattcccacacggcacggcacggtaattggcttgcgtgacatcggcagattggtgaggtgacacccagcgcagtgccgccgcgttcgcacagtgacacgctcgcctcgtgcgccatgccgtgctgatatgttgaaagggcagcaaatcccgcagaaaggaacgtgtagtgacgcttatcgagaacttcaccaagccttacggattggtagacaagatcgacgctttcggttacctcgactccctgaagaacaaccccgacgcaccgcgcaagcagggcaaggtggtgctcgtgacggcggataccccgctcaaggcatcacgtggcgagggcaagaccacgacgacgatcgcgctcatcgacgcgctcaacgagcgtggcatcgatgcggccgccgttcttcgccagccgagcatgggcatcaccgcagccggttcgaagggcggtgcctccggcggcggcaaggcgtcgctcacgcatcccgagctcatcgactggggtctgtgcggcgagatggggtcgatcgaggccgcgcagaatctgctcgtgtccttcgccgagaaggctattgacgacggcttgctcgacacggtgctcgtgccgcgcgtctccgaagtgccgtcgcgctcgctgcgccagattaccgtggaccgcggcaagggcaatgttcccgagcgcgtggtgctcacgccgacctgcgagctcatgcagatcgtcgtgctgtcgcgctccatggaggagatcgcagaccgcgtggcgcatatgattgccggcacgaaggacggcaagcccgtgaccttcggcgaattcattgacttgtggcgcatcacgaacattctcaccgacgccgtgaagcccgcgaaaaccgagaccgtgaacggctcgccggtgtacgtgcacggcggcccgttcgcgaacgtctccattggcattcctacgcttgtttccgttgagatggcgtgcgcgctgcacgacgtggtgatcgtcgaggccggctacggtgccgacgccggcgcgcagaagtggctcgacatcgcatgccgtgaatatggcgcgcagtggccgagtgccgcggttgtggtcacccgcgcgaccacctggcgcgacgatcctgccctgcagtggcgctacccgttccatgtcgatcgcttggagaagctcggcatccccaccttcccgcttattaatctgtgggagggcgaggatgaccagattccggccttgcgcgagactgcggaggaacttggcttccgcgacccgattgtgggcaatctgttccgcgatggcggcgaggcgctcgcaccgcagctcgacgcgttcgtcgaggcggtttccgacgaggcgctgcccgagcggccgaagagcttcaagggcgagtcgctgcgcgagaagatcgagttcgtgtgcggcaatgcgtacggtgtgccggcagaccgcgtgattgacaaggctggtttcgccgagtccgaggccgaggcggagcgcctgtgcgccgatgccggcatcgacttcgccgatctcgcgctggtggccgtgaagtcgccggccacgatgaccgacaacgacgccgcccccgccgacgagcgcaccgtgacactcaagaaggtggaggtgcattcgggtgccggtctcgtgcaggtgaacctgacgacgagcctgaccaccccgatgccgaagatcgtctgagcagcaaatcccttacgggatgtcaccaactcttacgggatgtcgccatccattacgggatgtcaggtctcaagtagacttgcctggggctttctgcgtttgcagggcgggactttagaaattgccgccgttccagccccagtccggggtggcggtgtagcggatgtaggtgcggtcggcggggatctgcaaggtgtcttgcagcgcgtccatgatcgcgggcgtgagcttctgccacgcagacttcgggaccgagctgccgaagacgttcacctcgacataggcggccggggcgtcgttcgtgccgccgaagtacatcgggacatcactttcgaacaggcacatgagccagccctcggacttgccggggacggcggggatggcctggccgaacgcggtcttgagcgcgtcgcgctgctcggcggtggtggggacggaaacatgcgtgtgaatgactggcattggtgctccttctttgagttatcgttgctatcgcttctagtgtaggcaagatcgagtgtggcgtttggatttttggccctgaacgttccagatgcgccgggagtttggctgcgtagggggttggggtgctgcgtaggaggagtggaggtgctaagtagagggttggaggtgcggtgtaaggggtgtgctgcggagaacgggctgtagagagggctctagatgtatggcctatttactctgaaatagcttacgggatgtcgtcaactcttacgggatgtcagtttttggatatcagctccctagagcaatcgattggtgattgatttccaaggttttttgggggttgatactttgggcgtgacatcccgtaagagttgacgacatcccgtaaggagaagaagaggggaagaagagggaaaagggagggaaaaaggatgaagaggtagggattagggaagtgtagtgtacgtcgtccacatgtggataaggagggataaggttatccacatcgtttaccgacacgctgttctccgaccacaatggcccgcaatggtgtacatgcgactcctaccgtgattggctggatgcatgattaccaacgaaatcaacaaaaaaccgcacggtatgatggccgatgtagagcagactcagatacgcatgagcggacggtgcagcgccttcctgaacgaacgcaagatggacgcgaccttcggactgctcacggctttggagctgctgggcatcaccacgccatggcttcgagcggcatacagtcgttgggaaaaagacaggtatctgcaaatcattgccgattcaagggggatgcggtatgcggaaaaacaccggtacggcgtcgcctattacaccatgaacgtcccgattcaccgagtcgaagtgtctcctggcatctactgcaccgatccggtatgtacatggttcatgatggcccgattcgtcagtctggactacctcgtggcgttgggcgacgctattctcggccccaacaatcgcctgagcgaattaggtctgcattacgagttagaagatttcatcagctacatcgaggaagtggaacaatggacggccgacccttcacacagcagaaaacgggcgccaagaggaatcggagaatgcaggttggcgatagaactcatgcgccagcgagtcgaatcgccacaggaaagcatagtgcgaatagatgtactcatgaagcacggattgccggaaccgaaaatcaactatgtagtcaatctggaaaacggacatacggcgagacttgatatggcatatccgcagtggaaaatcgccattgaatacgacggcaagcagcatgaggaaagctgggaggaagataatctgcgaagaaataagctggcggaattggggtgggcaataattgtcgtgacgagggccgacgtggcgacgccagaagcgcagttggcgtgcgcctacagaatcgcggcgagaatcgaggagcgcactcacgagcccatgccagtattcgccgacgggtacacgacagaggaattggcgatggtggttagcggaaaaccagtgcgcccacgtaaatggaggagaaagcggggaatgggtaagcgagaagtggcttaagtgccgccgcttgagagctactcccagcctttgggcgtgtgctcgatgctccacatgcccaggcggtgcgagaaactcttctcccacttcgcctcaagctcctcctcggaaagcacgttgcccttgcgacgcagtcggttcatagcgttcgtgtgcgtgtcgtcgagcagccacttgcgaatgatgaagttccagattgccacaatcaccgtggcgacgagcttgcccatgttcgtgcgcagcagatactcggcatgctgggtgatgaacgcgtcgcggttcatgccgtaggtggaaagccagataatcagcgcgttgaggaagagcccgacgagcgaggagaacaggaagatggccatctccatccagcgcgccatgtcggggcggtgcttgaacacgtatttcatactcgcgaaatagttgaacaccagcgagatgaagaacgaaatggtgccggcgatcacgttatgcatgtggaatacgccgacgagcagattgagaatgccccagtcgatgatgaaggcgatggcgccgaccacgccgaatttgaggatctgttcaatgagtttgcgcacgggacgattgtactcagagcggctgaaagcttgcttggagcgtgatgcgcgggtgaggtgcgacggttggcagtggtttgtggggcgtcgcaggttggggaggcttccgggatgtgggtatgggagagggaagggccagcgcccatctgcgtaatttgggacagatcggggcggggttttgtcccaaattacgcagaatgaaggaggggcggtcagcgggcggggtcagagctcgacttcgggcttggacggatcgtctttgatatgcgcgaacttggcggcgagggcctccttgttcttgcgctcgtcctcctccttagcggcgcgcttggcctcggccgggtcccacagaatgtcttcgcggtgcttgcgccactccgccgcggcaagcgggagtagggattcggcgagtacgcgggcggaatctgcggagtcgtcatcgccattcggcgtggcgaatgcggcgagcagaccgtgccattggtcggcggtcacgcagatgcgcggcacgcccagcgtttcggcgaattcattgatgaacgggagcagcgggagcgcgacgcgctcgagatggcgcacgcggtcggaggaggcgccgccggtgtgtggcgaatcggagccgagattggcgatgatctgtgaacgcagcacgcggagcatctgcgcgaacgtgaccagcaccacggcgaagcggtggtcgagcccggtgacgcgcttctgatcggtgtcatgaatatatgcagtgcagtcatcgaggatctcgccgagctgtttttgcgtcgcctcgctccagccggcagtcagcgtctcggcggcctcgaacagaagactgaaatcatgcgaatctgagtacggattgagctgctcataggcgtcattggcagcgagaagcgcgtcgacgacttcctgggggcgacccggaatcgcatccgcgccctcgtatacgaattcggcgtcggggagcgtgacctccgtggtgccgacgagcacgcgcgccattgtgagcgtgagccgcacctgcagattctccgcgtactttgcgtcgttatccatgcgctcggcggtggtgagcggccacagctcggtgaggtcggtgccgctgcgcacggcggtcttcattgcgggcagcgatgcgacctgctcgacggcgtgttcatcgttgaacgtcatgtgtatgctccttattcctcacgaagttctcatgttgggcggcgttcgttcgcgcgtgcgctgctccgcttcagtaatgatagttgatagcgtgcgatgcgggcggcattcttgcttacagattcttcggattcatgcctgtgggacgtcaccgttgcctacggggcgccttcaactcttacgggatgtcgcaatctcttacgggatgtcgcaatctcttacgggatgtcatcgctcaagtaaggttgttcgaaaatgttgacgaaactatcgttggtgttctgaaatcgtagaaaattgttcttgtttgagagattttagccgccctattatattttctttgcgaaagaaaacatcccgtaagggttggtgacatcccgtaagaaggagggtggtctccgagggatgatggcatcgggggatgatgacatcccgtaagggttggtggcatcctgtaagggttgatggcctcccgtaggagtggcatcccgtaagagatgatgatggctgggggctgaggcagcccgtggtattagtcgatgtgtttcgcggggtcggcgtaggtgatcgagaggaccttgccggtctcggaatcgtaggtgatcgaggtgacggacgccagcgcggtcttgcgcagcagcatgttgtgctcggggtggccggtctcgagcatgtgacggtacgaccagatcggcgactcgtgcgtgacgaccacaatctgctcacccgggtattcgtgcaccttttcgagtgcgaaatcctgcacgcgagcggcgatcgagcggtagctctcgccccaacttggcgtccacagattgcgcacgagcttgagattccgcggcttccacagtgcgccctcgccatgcccgatgcgcgtgccgcggaattcgttgcccgcttcgatgatccgctcgtcggtgagcagaccgagtgcctcctgcccgcgctcggcccgcaccttgttgagttcgagcagaatctcgttcgccgtctcgcgcgtgcggtcgagcggcgacgagtagaccgccacagccgtgttcagctgcggactctgtgcgatatacctgccggtcgcctgcgccatgcgtcgcccgcgctcggagaggtggaagtccgggaggcgttcgtacagcaaatggtctgggttgtacaccttgccgtgacgtacgaagttgatggtggtggctggcattccgggctcctcgcttgcataggtcacacgttcgcatgcggtgttcggccgcgcgaaatcattatggaaaaactttgtcgctgctaccaatgtaccgcgtgtcgcgatggtacccctctgtagtgtagccatgtttgccaaaacagcgcatacgtgacgcggtgttgctgggcggcggcatataatttcagattcgcagcgcacagacatcccgtaacgaaagagcctagcccgtaaggggtggcatagcccgtagcgggaaatgtagcccgtaaccgatttgacatcccgtaacggaatataagggcggacggaatctgaaaacaggaaaatcccggcgaaacatagcgggccgcgacgcaaagcggcgcagtcgggagtggtagtgagcagaaaggagcggcacatgtcgttactgcaaggtgtgaaagacgtgaaccaccgtattttcggcgggtacgcggagttgttgagaatcccgcatgcggcgaggttcacggtgggatcggtgattgcgtgcatgccgttcccgatggtgggcatgacgatgacgatcatgacccagcaatattacggaaattactcgctcgcgggcgcgctcaccgcagtgcaggcgattgccggcgccgtggtggggccgctgctcggcacgctcgtcgaccgattcgggcagcgacaggtgtcaatccccacgatcgtgatctggatgctcgccgccgtctcgttcgtcacctgcgtgcgcgcgcaagtgacgccgtggatcctgttctgcatcgtgccgttcttcgccgccgtgccgccgtggggcgccatgagccgcgcgcgctggacgtacctgatgggcaacgatcgcgccggcgtcaaccgcgcgctctcgctgtcgggcgtgttcgacgaggcgatgtgggtggtgggcaatccgctcgcgtccacgttggctgtgatctcgggatttctggcgatgtcgttcactggaatctgcgtgctgatcggcgcgctcatgttcctcacggagatgaccacgtgcccgccgagccagtctgacctcgcccgcgaagccggggtctcgcgcaaggaattccgtgagcgcgaggcggagaaggcgaaggagctgcgcgcgcagaccgccgccgaagacgcccgcgtgcacgcgaagtcgcagggcctgtccgacgccgaggtggaggccgcgggcaaggcggcgtacgagcggtcgatgagcggcatcaaggactccatttggggtccgggtctcatcgccgtgtgcgcgacgtggttcgggctcggcgcgttccagtcggcggccggtatttcgatcatcgccttcgccacggaggcgaacatgaagcagtacaccggattcgtgttcgcctgcttctcgatctcgtcgctcaccggcgcgctgctgtacggcgcgaaaaactggacgatcccgctgtggaagcgcttctacgtgtgcctcgcggtgttgaacattggcatcggctcgttcctgttcgcacgccacctgtgggtgatcatggtgatttacctcattattggcgtatgccagtcgccgacgtggatcaacggcaaccagctcatgctgcatctcgtgccgcagacccgcttcaccgagggcatggcgtggatgggcgcaatgaactcgatcggcgcttcggccggttcggcggtcgccggcgtattcatcgaccgcgccggttcccacggcggttttgcagtggtgacggcgcttgcgttcgtgtcgctggcgattgcgctgctcggcttcaagcagatcaagacgagcaccgagaccccggtgctcaccgagatctccgcgtagcttacgggctacaattccccttacgggtcaagatgtgccttacgggatgtcattatttcttacgggatgccacggcccgagtagagttgtgcgaaaatgtttgcaatcatatgatttgtgttcatttgatgagacagaagaccttagtttgttggattttgtgtaatttgaaattcatttctaaagaaagaaaacatcccgtaacagattagggtagcccgtaacagattagggtagcccgtaacagatttggggacgtagcggatttgggggatggcccgtaacaggaaatcctagcctgtaaggggaatcttagcccgtaagggttagtttggcccgtagcagatggcctgcagcagatagcggcagctaatcggcatcctcgacaaaagcggctcttctcaggttagtgtgtaaggatgtctttgagttggctgctgtggatgaggcatcgttggatgtagctggtggtgttggcgaagcccatggcgttgccgcgcagggtctcgagcctgccgttgatggcttcggtgggtccgttgcttgagcgggggtggcggaagagggcgaggatgtcgcgcatgcgtcttttgagcacgcggccgagggaggcgagttcccggcagcctttgtagcgccccggtccggtcaggtcgtcgatcagctcgcgcatcatgcgttcgccgcgtcgcctgtcgtcgcaccggtaggcgtgtatgaccctttggtaggcgtcgtgggcgagcatgaggtcgcggttggcctggatggcgaacagggccatgagtctggcacggccgcgtgcgccgaggtattcgtcgctggtcagcagggcgcgcctgcagtcgtagagcctgtcgcccttgacaccgcgcctgccggtggcgtcgcgttgcaggcggcagcgcaccttggtgacgcgggcggcggccagttgcacgacgtggaacgggtcgatgacctcgaccgcgtggggcacgacggattcgacggcctgcttccagccggcgaacgcgtccatggcgaccaccccgacgcgtcttgtgaactcgccgccgcgcgcctgcatccattcgcgaagcacctgggcggaacggcccggcaccatgtccagcagtcttgccggcctgccgtcgcaacgcggggtcaggtcgacgatcacggtcacgtaccggtcgccgaacgcgccgtggcgccacacgtgctcgtccacgccgatcgcgcgcaccgaggagaaccggtcggcctgctcgagcaacagcatgccccgctcgcgcaccgcccggtcgaccaccgcccatgccacatgaagcagcctggcgcacgccgagaccgtcatcgagtccaggcacacgcgccgcagcgcccacatcaccgccggcacgctcaacacgcccctgccggcgcccaccgcctcaagatcatcgctccacgagcgtgagcacggcacgcactcgtagcggcgcacgcgcaccagcagatgcaccgcgtcgtcgccgtagggcacatgcgccagcgtgcgcagccacgacgaacgcaccctggcatacgcgccgcacgaggggcaccagcgcgcgtcgtgcgagtccggctcgcacctgatctgccttaaccccgggccgtccggcctgccaagacgccgccacgagagcacacgaagacccatctcatccaaaccaaggaaacgttgggggtcgaacacgctaaactcgggttcaggccgtgtttcctcattcaatttctctatcacacaagcaatgatgaagcacggcccttacacactaacttgagaagagccacaaaagcgccgcgcacgtcgggttggcggggcagaatagtgggcatgagtgaatctgaaaacaatgagtcgaatcatgtgaaacccgcgcttcccgagaacgtgcgcgtgaggttctgcccgtcgccaaccggcatcccgcacgtgggcatggtgcgcaccgcgctgttcaactgggcggaggcgcggcacaccggcggcacgttcgtgttccgcatcgaagacaccgatgcgcagcgcgactccgaggagagcttcaaccagatcatcgaagcgctgcagtggctcggcatcgactgggacgaaggcgtcggcgtgggcggaccggacggtccgtaccgccagagcgagcgcgggcaaatctacgcggacgtcgcgcagaagctgctcgacgcaggctatgcgtacgagtcatactccacgccggaggagatcgaggcgcgcaacgaagcggcagggcgcccgaaggcgttcggctacgacggctacgaccgcaatctgagcgaggaacagaaggcagcgttccgcgcggaggggcgcaagccggcactgcgcatcaagatgcccgacgaagacatcaccttcaacgacctcattcgcggcgagatcacgttcaaggcggggtctgtgccggattacgtgatcgtgcgcccgaacggcgacccgctgtacacgctcacgaaccccgtggacgacgcgctcatgcgcatcaatgtcgtgttgcgcggcgaggatctgctcagctccactccgcgtcagattgtgctctaccgctaccttatggaactcggcattgccaaggagatgccgctgttcggccacttgccgtacgtgatgggtcagggcaacaagaagctttccaaacgcgacccggagtcgaatctgttcctgcatcgcgagcatggcttcattaaggagggcctgctcaattatctggcgttgctgggctggtcgatcgcgccggaccgcgatatcttctcaatggacgagatggtggagaagttcgacgtgcgcgatgtgaaggcgaatccggcgcgcttcgacattgacaaggcgatctcgatcaacgccgagcacattcgcatgctcgagcctgccgatttcctggagcgctcggtgccctacctgttccgcgatggcgtggtctccgcggattcgtgggatgcgctgaacgagcgcgaacgcgacattctcgctgccgccgcgccacttgtgcagccgcgcgtgcgcctgctcggcgaagtcgcgggcatggtcggctcgctgctttcggacgcagactacattccgccggcagatgatgcgaagaagcagctcaaggattcagccggcgccgttctggatttggcgattgccgcgctggattccgttccggagtcttcgtggcgaacggatacgctgcatgagacactgaacaaggcgctcgttgaagatggtggctacaagccgcgtctcgcgttcggcccggtgcgcgtggcgatgagcggccgccgtgtttcgccgccgctgttcgagtcgatggagattgttggcaagaagatcacgctggagcgcctgcgtggtctgcgcgagcatctcgctgagattcagggctgagcgatgaggtccgtttagtcgtgagaccgttaagcaatgaagtcgaggtgggagcctcggctttttgcgttacggagtgaacaaccggcgttatggcgtgaacaaggcaaaagttgcagttggtcgaaccactgatattccaaggaatctgcgattggtgaccttgacgatgttcacgccataacatcacattgttcacgccgtagcgcgcgagggcgtgcgagggcgcgcgggggcgtgcaggctggctgaaaactgggggcatgcgggtgcgacacgccggagttgcgcacattcggggtttcgagtatattttctatctgttgcttcacggaagcgacgagatgatgcccccatcgtctagcggtctaggactacgccctctcacggcgccaacaccggttcaaatccggttgggggtacgagttcttcgggaaaccgaatgaacatgccaaattgggatgtggtgtaattggcaacacagctgattctggttcagccattcttggttcgagtccaggcatcccagcgaatgaacctccactcagtgtggaggttttttgttttgtctgccgcttgtgagcaggggtgaagcaagacgcgactggcgtgcgaacgcgcggcggatgggttagagtaggcggtatgagtgagcagtctgcggaaatgagcgaagccaagccggtgtcggtgtcgcgccggctcgggcgcttgcagttccacaaatcggggaaattccgtgtgctgcagctggcggacgtgcaagacggtccgaagatctcgaaagacacgattgcgctcatcacggcggcgatccgcgatgcgcggcccgatctcgtggtgttctcgggcaatcagatcgcaggttacgaccccgcgttcgccgcgacgttcacgaaacgccggtggaagacggcggtgggtgcggcgcccaaatctgcggacctcgcccacacgcgcgagctcgtgcgcgggcagatcgagcagatggtgcagccgatggttgacgcgggcgtgccgtgggcggtgacgtacggcaaccacgacttccagtgcgggctcacgaacgcggagctcgacgggatcttccgcgaattcccgctgtgtgtgaatccgtcgacgcgcgcgaaattcggtgcggagacgtggtcgcgcgcgctgccgaaggagcgtgtgatcgcgagcggcgagccgggcacgttctcgatgccggtgtgtgacgaatctggaaacactgttttcggaatagttcttgtcgattccggagattattcggaaaccggcggctatggcgcaccgtcgcagaccgcgctgcgattcctgcgcaccgtgccgcagtggtttggcgaaggcgtggaatccatagttttccagcatatgccgttgccgcagtattaccgtgtgctgaaaccagtgccgagaacgacggatcggtctgtagaggggtacagaaattattccggttcatactttgtgctggacgacgcgaagaccgagcgcggcggatatttgggcgagggcgtgagctgcccggacctcgactcgggcgagttcgatattctgcgcgattcgcacgcctacttcgcggtggcggccggtcacgaccaccgtaacgcgttcgccggcgagtatgcgggcgtgcagatgattgcgacgccgacgtgcggattcgactcgtacgggccgattccggaacggcgtgcggcgcgtctgttcgagttcgacgagcggcacccgttctcgccgcgcacgcagctgctgcagttcggcgagttggtgggcaagccgagctcgaagaaggcgtatgtgtatggcatgagcagcgcgtcgaagccgaaaagcgagggcgtgaacctgctgcacaagccgagcacggtgagcagattgtggcattccgtgggcaactggctgttcaatcactgagcgcggaggttttacggttttggtgtgacacatgccgttttggtgtgacgatggctcggtggcctcgatttgcaaaacgttggaattccaacattgttatggtcatgggtttgtgggtgccgtcacaccaaagcggtttgcgtcacaccaaaaccatgtgagcgtgggagacgttgccggcacgacgtttggctcgtcttgccgtcgtctcgttgtgtgttacggccttttggcttacgggctgggattttctgttacgggctaaggtagccgctacgggccaagataacgcttacgggctaggatttttggttacgggctaaaaggggcgttgtattcggcaacaacaatcgttggaaaatggcggttttgtgtttttggggaattgctggatacttgccaggttgcagattttcgctagcccgtaaccgaaaggcctagcccgtaaggagttggctggcccgtaaggggccccatagcccgtaacagctggtgacatcccgtaacggataaggacatcccgtaagagattatgacatcccgtaacagaaaaccttagcccgtaacgttgtatgagacggagacgcgaaaagagaaaggcggccaaccgtggggctggccgcctacttgcggggttgcggaatgtatgtaggtcggttgcctacttatggggttgcggaatgtgcgtaggttagttgcctacttgaacgcgatgatatcggatgcgttgcggttccgggggcatcggatggccgccgaaatcggtcagcgcgagatgctggccttgatcagcgcatcggaaaggtacttgccggcgcccatgacgagcggggcgaaacggtggcccggattcgagcccatgcggcccgagggtcccgagatcgagatcgcggcgattacctggccggaggcgttgcgaatcggcgcggagatggagcagacgccctcatcgcgctcgttgatcgagtcggcccagccgcgcttgcgcaccgtggcgagcttggcggccgagaacttcgcgtgacgcaggccctggtgaaggagttcggtgtcttcccacgccagcaggatctgggccgcggaaccggcctccatcgagagcatggcgccgaccgggatcgaatcgcgcagtccgctcgcgcgctcgacggcggcgatgcacacgcgctgttcgccctgacgacggtaaatctgcgcgctctcgccagtgcggtcgagcagcgtctgcagaatcgggccggcggcggcgagcaagcgatcctcacctgcggcggcggcgagctcggtgaaacgcgagcccagtacgaagcggccgtgctggtcgcgcaccacgaagcggtggcgctccagcgcgatcgccaagcggtgcgcggtcgggcgcgcgaggtgcgtcgccgcgacgagctgaccgagcgttgcggggccggactcgagcgcatcgagaatctttacggtcttgtcgagcacgccgacgccggaatgaatctcgttgtcgtctgcaggcacatcgttgtgattggacggattgtttgtgctcgtctcagcagacggagcagattttgcggcaagcgtatctgaagtcatactgagattattgcatctcagtattcgaaacgcaaaacgacaaactgggcatttctgttggattagtctgcttaagcgctcaaattccgcggaaaatcaggtgttttacagtgcgaaaacaatctgcaacatctttgaaaaaaccttcacatctcgcattctgacatagtacgcgaccggcgattcgccaacctttagtctggacagacaagctcgcgtgtggtaagcgagcggcgcgggaaaagcaagggagagcgcgccccgcacacgcgacaacactaggaggaacaggtttatgggaatgacattggccgaaaaggtttgggccgatcatttggtgcgcaagggcagcgacggcgctcccgacttgctgtatatcgacctcatgctgatgcacgaagtgaccagtccgcaggcgtttgaggggctccgcctggccggtcgcacaccgcggcacctcgaccagctcatcgccaccgaagaccacaacacgcccacggtcgacatagacaagccgaacccggacgagacgagcgccacgcagctgacgacgctcgagaagaactgccgcgaattcggcgtgcgcttgcacccgctcggcgacgcggaccagggcatcgtgcacgcgttcgcgcccatgctcggtctcacgcagcccggcatgacgattgtgtgcggcgattcgcacacctccacgcacggcgcgttcggcgcgctcgcgttcggcataggcacgtctgaagtcgagcatgtcatggcaacgcagacgctctcgctcaagccattcaagacgatggcgatcaacatcgagggcgacctgccggcaggtgtgagcgcgaaagacatcattctcgcgatcattgcgaagatcggcaccggcggcggccagggatacgtgctcgaataccgcgggcgcgccattgagcagctgtcgatggacgcgcgcatgacgatctgcaacatgtcgatcgaagcgggtgcgcgcgccggcatgatcgcgcccgacgagacgacgttcgcatacctgaaggggcggccgcacgcgccgaagggcgagatgtgggatcaagcggttgagtactggaaaacactgcgcaccgacgacgacgccgtgttcgacgccgaagtgacgctgcgcgcggaagacctcgagccgttcgtcacctggggcacgaacccggggcagggcgtcgcgatttcgggcgtcgttcccgcgccggacgatttcgcggacgccaccgaacgctccgccgccgagcgcgcgctcgactacatgggactcgagccgggcacgccgatccgcgacattccggtggacaccgtgttcattggctcctgcacgaacggccgcattgaagacctgcgcatcgccgccgagattatgaaggggcacaagaaggcggattcgattcaccgcgttttggtcgtgcccgcgtcgtcgcgcattcgcctgcaggccgagcgcgaggggctggaccggatcttcaaggatttcggcgcggaatggcgcaatgccggctgttcgatgtgcctgggcatgaatccggacaaactcgtcgcccacgaacgctcgatctcgacgtcgaaccgcaatttcgaagggcgtcagggcaagggatcgcgcacgcatctggcatcgccggccgtcgccgccgccactgcgatccgcggcacaatctcgacgccggcggatctgtgaatcgggaatctgaaaacttacggaaatagggactgttatggaaaaacttacgactattaccgctaccggcgtgccacttcgccgctcgaatgtggacacggaccagattatccccgccgtgttcctgaagcgcgtaacccgcactggtttcgacgatgcgctgttctacgcgtggcgtcgcgacccgaatttcgtgctgaatcagccggaatatcgcgacggaaggattcttgtggccgggcccgacttcggcatcggttcgtcgcgcgaacacgccgtgtgggcattgcatgactacgggttccgcgtggtcatcgcgtcgcgttttgcggacatcttctatggcaacactgcgaagaacggcgtgctggctgcgattatgccgcaggagtcgatcgagctgatctggaagatgctcgaagaggagcccggccggcagatgaccgtcgatctcgagacgcgcaccgtgaccatcgacgacgtggtgctgccgttcgaggtcaatgattacgtgcgctggcgcctgatgaacggctacgatgacattgacctcacgttgcagcacgaggacgacatcgccgcgtatgagcgcatgcgagcggaaaaattcccgttcaaaccgaagacgctgcctgcgatcacggaggaggctgaaacggtggagtcggcacgcgagcctgaagcggttgagtgggcgggtccgctcgccgatcgctgaggcgaggcgctccgcgcgggcggcgtgcggtcgtgcgtcgcgcggcttgagtcgcgtggcgtgagtgcgtatggccaacataatcgttacgggatgtcacagtacctaccggccaacaatgctgttacgggatgtcacagtgcttatggccagggtgttcgttagggtgctctgcgtgcatcgcggcgagcggcatgcgtcggcgctgcgcggggtatcgttgaaggaacgggaagttgttctaaggagccgagatggcagatgcaatcgttctcattaccacacaagccgacaaggtgagcgaggcggcgaagaaaatcgttgagattccgggcgtcaaggacgtctattcggtggcgggtgacgtcgatttggtggcgatcgtctccgccgacgatttcgacgacctctcgacgatcattcccgacggcatcgccaaggttcccggcgtcgccggcacgcagacgttgatggccttccgcacttactcgcgcgaagacgatctcgccgcattcgatctcggtggcgactgagctcgccggttttgtcgtgtattccgctgacggctcctccgcacggaggggccgtttttctttacgcgcctattgtcatctcttaatctgctatctcttacgggctaaggtaataacagattcgtgcttaggggtacaggtctcttcctcggtggtacaggcagagtgttaaggagcacggatttatctgttaacagatttcataaatctttgaaaaataaggatttcttgtaatctgcattcttatagccctgtaccctcaaaactctgcctgtacccccgaggaagagcctgtgtcagcggtgtcccgattgtttcacagtcgaaactcactctgtacctctgagcagaagacctgtacccctgagaacatcgtggaccctaaagaggtgggttgtggtttgaccagtaagtgagatgaggcgagtttagatgaatgagtttgaatgaaaaagagtaggagaggggttgtctgcagaggtggggctggcccgtagcgtaatgtagagccgagaggtatctttcctcgcttacgggatgtcggcaactgttgcgggatgtcgtcatctgttgcgggatgtcatgcatcaagtagacctgtgcgagaatgtgaacaattgtatcgtgaatgttcgcccagcctgtcgtcatgtttctatttgataagttttgggccatttgaaattcatgccgagaacaataaaacatcccgtaacagggtatgacatcccgtaagaattgacgacatcccgtaagggaaaggagaggaggaagaggaaggaagaggaagaggaagaagaaggggaagtgggggtctcctcttggggtgtctcccctggaggagctcctgttggggggggggggaagtccatgctgggggactcccccccccaacaggagggcatgcaggagtcagcgctgctcggcggcggcctttgcggcgaccgcgccgacatagtagacgggctggtcgaagttcggctggaacaggaagtccacgttcgccagcatgtcgatggtgaacttcgcctgaatcgccaccgagaccacgtttgcggcgccggccacctcatcggtggtcgagcagaactgggcgcccttgaccaggcgggtctgcggatcccaggtgagcatgcacgagaccggcgcggtggagagcatgaatgcgggacggtaatcttcaagcagctcggtggagcggatgtcgagaccgtggttgttcgcgtaggtctgcgtcatgccggaagcggcgagcgagaggtcgtagagctgcacggccgacgtggcctgcgtgcccatgtacttgcgggtcggcttctcaatgttcaggccgacgagctcgccctgacgcaccgcattggtggcgagcggaatgtagtcgagcttgccggtcgggttgaacagcacggtggcggagtcgccggccgcgaacacatccggcaccgaggcgcgcatgaactcgtcgaccacgatcgcgccgttgtccagcgtctccacctggccgcgcaccaagtcggtgttcgggcggaatccgacggcaagcaccgcgtacggcgccgtgtactcgcccttcgtcgtgaccacggtgatgctgtcgccgttgtcgcggaacgccttgaccgcttcaccaagcgccagcgtcacgccatgctcgcggtacttcgcctcaacctgatcggtgatgaacctgtcgaaattattggcgagcacgcggtcggcggcgtcgatcagcgtcacctgcgtgccgcgcgtggagaactgctcggcgagctcggcgccaatgtagcccgcgccgatcacgattacgttcttcagatcgtgcgcgcgctccttgatctgcaccgcgtcatcccagttcttgcatagctgcacgcgcttggaatcgatgccgggcagcggcggcacgatcgggcgcgaaccggtggttacgacgagcttgtcgtagggcagggtctgggtgtcgccggtctgcaaatcgcggaattccaacgttttcgcggcaacgtcaacgtcagtgacgtcggtgtgcatatgcacggtcgcgcccgcctgctcgagcgcttgaggggaggagtagaacatcttcttcgggtcggagacgtggccgcccacccacagcgcgatgccgcaggagaggaacgagacggtctcgttgcgctcgaacacgtgcacctgccaatcagggtgttcgcgaagaatggaattggcggcgaaaacgccggcgtgggtgcagccgacaacggcgacagtggtggtcatgatgctcctttgagtcccgaaaacactagtgctacctgagatggtaggtgtggggtgcgggcggtggcgcggggtttcgcgaatggtgagcgcgggggaatctgcccatatgaagaactacatggtgtgtggcagaatggtggggaattgcgctcgcgggcggtaccgaggcggtgccgaaataaaacgcgcgcgggaactgttggaagcatttaggaatctcgaatcgtgtgcttgaaagagcttgaaagaggtggacgtggagaaaactgacgacgtactgcatgtggtgggcggcaagccgctcaacggcacgatcaaggtgcgcggtgcgaagaacttcgtaagcaaggccatggtggcggctctgctcgcgccggggacgtcggtgctcaaaaacgtgcccgaaatacgagacgtgcatgtggtttcggatctgctgcgtctgcacggcgtgaacgtggacgtgaacggcgacgagggcattgtgacgatcgacgcgaagaacgtgcagctggccgacgtggccgatgtagacacgctctccggctcgtcgcgcattccgatcctgttctcgggcccgctgctgcaccggctgggcgaggcgttcatcccggcgctcggcggctgcaacattggcggccggccgatcgacttccatttggagacactgcgcaaactcggcgccaccgttgacaaggaacacaaggacggcattcacatcaccgcgccgaacggtctgcacggcgcgaagatccacctgccgtacccgtcggtgggcgcgaccgagcagactctgctcgccgccgtgctcgcagatggcaagaccgagctgtccggcgcggcgaccgaaccggagatcatggacttggtggccgtgctgcagaagatgggcgcgatcatctcggtggacgtggaccgcacgttccgcatcgagggcgtgaaggagctgaagggctacactcacacggctctcaccgaccgcattgaggcggcgtcgtgggcgtcggccgcgctcgccacacacggcgacgtgttcgtgaagggcgcgacgcagccggagatgatgacgttcctcaatgtgttccgcaaaatcggcggcgagttcgacatcaccgaccgcggcatccgcttctggcacccgggcggcgacctgaagccggtggcgatcgagaccgacgtgcaccccggcttcatgaccgactggcagcagccgctcgtcgtggcgctcacgcaggcgaacgggctgagcattgtgcatgagaccgtgtacgagaaccgtttcggtttcacgaagccgctggtggagatgggcgcaaccgtgcagctctaccgcgaatgcctcggctcgttgccgtgccgcttccagcagcgcaactacaagcattccgctgtgatcttcgggccgacgccgctcgaagggcgcgacatcgacgtgccggatctgcgcggtggattcagccacctgatcgcggcgctggcggcgaagggaccgtccgacgtgcgcggcatcagcctgatcgaccgcgggtacgcggacttccgcggcaagctcacggcgctcggcgcgcagatcgactagtttgcgccgttctgcttgcttgaacagaacgcttgaagatggtcacccctgctgggggcggccgtcttttgcgttatggcgcttctttttcgttacgggatgtcgtcaactcttacaggatgtcagattctcgcgccgcagttgataaacacgacaatatagcgggaatttcaatgttttttggtaccgatacttgggccgtgacatcccgtaagggttgacgacatcccgtaaggaaatctgggcgcctagcgcgcggccggtgagtccgcgcgtaggctgaatcttgaatctgcgcaaaaggggacatctaccagcatgtagatgtccccttttacgcagattattgtcggcagatttttgtttgcataatttgggacattttggggctctgctttgtctctttttacacaaaggggcgctgggtgctgagggggaccggggtgccgaaggtgcggcagaggcgtgcagaggagggggcgtggcagaatgggggcatggtatcgaaagggaagccgtcgccaaggcgcgccgtgaagccgctcagcgacgcgcaagtgcgcaaactcgccgcagaatatgctctcgtggacccgacgcgtccgttcccgatcggcagaatggagccgaatcagcgggaaattgatgagctcaatccgaaaatcacgcaccgcttggtggaaggcgcggcgaaagttctgcgcgcgagctgcaaagtgcgcgcgtggggcttggaaaacgtgccggtggaaggcgcctacatcacctgcgcaacgcatgtcacgcagttcgacgtgttcgtgcccatggtcgcgatgttccaaatgggccgtcgtccgcggtacatggccaaggcggagatgggcaaatggccggtcataggcaaatggttccgcgcggtgggcatgcagccggtgccgcgacgcagcggcaaggcgcgcgagatcgaggaagcgtcggtacagattctcacgagcaatcatgcgctgacgatctggcccgagggaacggtgacgcgcgacccgaaaaagtggccgatgagcatgaagaacggcgccggattcatcgcgctcgaggcgtcgcgccgcgtcggtcaccagattccgctgttctgcgcggtgacgtggggtgcggcgagcatcaatcattggtggccgtggccgcgcaagaacgtcgtcatgtgctacgacacgcagctggattactccgacttgctcgcgaacatggactcgtggggcgacgacccgcccaccgagctcgcgaacgaactcgtgcggcgcgtgcgcgtgcgcatgaaggaggtcatggcgaacatccgcggcactgcggcgcccgacacgttctacgattaccgtatcgagaaggaagtgccggaagtgccgccgttcagcgacccgcatgagattgacaggcgcgcggaggaagcggaggtgcgcgttggggaatctgtggaatctgcagattcagcaagctcgcatgcgcgctaatgcttacgggatgtcgttaatgcttacgggatgtcgttaatgcttacgggatgtcataagttcttgcgggatattggattgtgacgctcgctcgaaaacgtgaagtttgaaaagggccattttccaagggttttgtcgcgtcggcactttgcttcctgacctttcgtaaaggtttgtgacatcccgtagcggtttatggcatcccgtaagagatacggagaggatagaagagcgagagggtgagacggagaaatcggcaaacagctcgccggatttgcgctagcaacgcaatgcggggacgcgacggcgaaagcgagcgacaatcgagaatagctgtctcaagtaaggagtaggcatggcgaatgtcacagttttgggcgccggcgcgtggggaaccgccttcggtcaggtgcttgccgatgcgggcaacgatgtgatgatgtgggcgatcgagccggagatcgtgaaggcaatccagaccgagcacaggaatccggtgcgtctgccgagcgtggagaaactgccggacaatatgaaggcgaccggcgaccgagccgaagcggttgcgcatgccgacgtggtcgtcgtggccatcgccgcgcagtacgcacgcggcgcgctcgaggaattcaaagggctcattccagattccgcactcatcgtctcgctgatgaagggcattgagaagagcaccggcaagcgcatggaccaggtggtctgcgaggcgctcgatctgccgacccagcgattcgccgcggtctccggaccgaatttgagcaagcagatcgccgcgcgccagcccgccgccaccgtgatcggctgcaccgacatcgacaacgcgcgcatgatggccaatctgtgcaccaccgactatttcaaggcgttcatcaccgccgacgtgatcggcttggagctgtgcggctcgctgaagaacgtggtcgcgctcgccgtcggcatgagccacggcgcgggttacggcgagaacaccgccgcgatgatcgagacgcgcggtctcgccgaactcaccgccgtgggcactgccgccggtgccctgccggagacgttccacggactcgccggcgtgggtgatctcatcgccacctgcggctcgccgctctcgcgcaactacacgttcggcttcaacctcggcaagggcatgagtgttgccgaggcgacgaaggcgagcgacggcgtggcggaaggcgtcgccacggccagcgcggtcgtcgagctcggcgagaagtaccacgtggacaccccgctcgccaaggccgtcacgcgcgtgctcgacgacggcatctccttcagccagatggtctccgagatgttcccgcagggcatcaccgtggagtgacccgcccgaattcgcatatttttgtagattggcgcgcccgcatttggtttgcgggcgcgcttttgcgttgggggccttgcccgtaaggggtagattggtccgtggcaggtgacatcccgtaacagaaaaggctagcccgtaagaaatagtttggcccgtaagggaaatgttggcccgtaacagttatcttggccggtaagagcagcccgtaaagtggcccgcaagagtggagggcggggagagcggctagtattcttgggaggcagcgcgggcgccgcgttccgttcattgcggaggcggcggctcacaaggcatggagcagaatcccgggcgcaatatgcccgggcataaggagatggcaatggcgaagacacgggtggcggttctctacggcggcaaggcggacgaacattcgatttcctgcatctccgcagcctcattcatgcgcgcgctcgaccctgaactgttcgaggccgtgccgatcggcatcacgaagaccggcacctggttcgtagacggccaggatccgctcggttggaatctggccgaaggactccccgaggcggttgagacgcccgattcgcgcgaagtggtgctcaccattggcgacggtggcgacgggttccacgcccgcaatgctgacggctcgcttgattcgctcggtcacattgatgtggtgctgcccgcactgcacggcccgtttggcgaggatggcacgatccaaggcctgttcgagatgatgggcgtgccgtacgtgggctgcggcgtgctcgcctcggccgcgtgcatggacaagcactacaccaaggtgctgttgcgcgccgccggcattccggtggcgccgggcatcacgctcgacacccgtcactacgacgcctccgacgagttcgccaccgacggcgaggaattcctgcggcaggtgaacgaggccggtttgcagtacccgttgttcgtcaaacccagccgtgccggctccagcttcggtgtgaccaaggtggagcagattggcgacgcagccgcactcgccgccgctgtgttcgaggcgagccggcatgattggcgcgtgctggtcgagcagggcattgacgcgcgcgaaatcgagtgcgctgtggtgcgcattcacccgaccgacccgacccgtgccgcgctacctggcgaagtggtgctcgaccggcgcagcgaaggcgacgaccagttctacgatttcgacagcaaatacatggactcccaggcgagccacaccgagattccggcgaagattggcgatgacctgatcgcgcgcgtccgcgagaccgccgtacgcgcattcgacgcggtggacggcatgggactgagccgtgtggacaccttcgtgaccgcagatggcgatgtgcttgtcaatgagatcaacacactgccaggttgcacttcgatttcgatgttcccgcaagcgtgggaggccatgggcattccgttccgcaccgtggtcaccgacctcatcgaaggcgcgctcgcctgagccgcggatgtacgttgccgccaatctgacgcaatgccatgttctcagtgcactggtgatgctgtcgggaggcaagacgatttacgacaagacctcaccggcagcgactaatcccaccattctgagcatccacatgcatgggtggcgagaaacaatcttcaagcgacacaatctgagaaagcaaactataaaaacatggaatgattgactagacaccaagtgcgaatttgataggctgttgctgtttttcgacagagggagaataatgacacagccagaaaatccgtacaccggtggcgaacagccagcacagccaatcacgccgccggcggatccgtacgggctgaatccgaatgccaatccgaacccatacacgcagccgcaggaaccggcacagccatatgtacagaacgcagcgccagagcaggggcgcgaggcatacggcaactcgaattacgggcatgccgaatctgcgcctcagttcactggcaacgagccggcacagcagccgtacggcaccccgtatgagccggtgggcacgcagccgacgacccagatcaactacggcgccccgcagaacgcggcaccgcagtacggcgagcagccggcatacggagcgcccacgggaggagcgccggtctacggtgaaccgggtggccccgcatacggcggcccggcacagttcccgccgcagggtggctatgatcagtacccgccgcagggtcccaccgacaagtacaacacgatggcaatcgtcggtctcattctggcgattctgttcccgctcatcggtctgatcgtgtcgatcatcgcaatggtgaacatcaacaagcacggcggcagcaaagcgagcaagaatctttcgctcgccggtacgattgtgggcggcgtgctcaccgtggtctccatcatcgtgtcgatcatcgtgttcaacagtgttctggcggcgacgaacgagatcgtcagcgattcgaagtcgccgagcgccacgcattcgcagacccagagcaccacggaccccgacgaagacattgatgaggacatcgacgaggatatcgacaacgacatcgacgacatcggcggccagctcaccggcggctcgatcacgctcgaagaggcgctcaagaacccgaccgtgaagagcgagctcgaaaagcagattcaaggtctgccggacggcatgaagggcagcgtctccgccgagggcaacacactgatcctcaccttcgacctggattcctcgctcgcggaatactccgattcgctggccgagagcctcaattcggtgggcaaatccgcggcttcgcagctcaatgaggacggcggcaacacctactcggtgcgcattgtgatcacgtcggagggcaagacactctacgacaagacctccaccaacgactgatccgcggcagatttgcttgcagattcgcgcgacagggcggcatccggaatttcgggtgccgctttttccgtgttcctttaccgcggcggcacactgccgagcggaatcaagtgcggtccacttggtttgtttcgcaaaactgggtaagagcgggcggatatggaacaggaggacggcaacaaggcgggtttggtaatctgaggctatttcatggcagatgagcgcaaggagcacaatgaccgaaccgggacgcccgcagagtccgcaacagaacacacgggcgggtgaattccagcaggcgtggcagggcgagttccagcagccgcagtattggcaggaaccgcagcagaatccttggcaggaaccgccgatgaatcagatgggcgaacggaatgcggtggaatccgcgcgcaggtcttactcgcgcataggggcgtcgttcagcgtgatgatcgtggtgtggatggcgctcgtgttcgtgctcgggatcggcattagcatgctgcaccgcgaagccgcgcactggatgtgggtgtcgctgctcgtctccgactgctcgttttacctggtggccgtgccgctcgcctacctgatgctcaggagcgtgcccgaggagcccacgcgcaagttcggcatgaccttcggcgaactgttcgaatggttcctcgtgagcctggccatcgtgttcgtgggcggactgctcggcaacgcgctcgccgcgctgttctcgggcggcatggcacagaaccgtctcgacaacattgtcggcggaatcccggcatggctcaatattctcgccgtggtggtcgtgggcccgatcgtggaggagtggctgtgccgcaagcagatcatcgcgcgcgtgcgccgctacggcgagcggttggcaatagtggtgtcggcgctcgtcttcgcgctgttccacctgaatctgtaccagttcttctacgcgttcggactcgggctcgtgctcgggtacatctacatgcgcacaagccagctcaaatacacgatcggattgcacatggcgatcaatttcctgggcagcgtggtcggtccgttcttcagtgactggagcgacgcccattccgccgcgctcgatgccggcgatgtgtccggaccggaactcgtcgtgggcgtggccgccatgctgtacattctgctgtatttggtggccgtggtcgcgggcgtggtgctgctcattgtgaaatgccgcagactcgagttctacgtcacgcccgcgcaactgccgaaaggcactgcctgctcgtgcgcgttcgtcaacgccggcatgggcgtgttcatcacgctgacggtgttcggcatggtgttggcgcttatgaacgtgatgtagatttgccggtgagcgcaccgctttcgtcaatgccgaccaatgaggacgccgtgaagttcagattgagcttggaactgtgcactgcgcgcgcgatggcgtccgacagcgcggtgagcgcgacgccgtgcttcgcgtaggccacgatgttgccgctcacgccgtcgctcgtgaagccggtgtagcgtacgaccgccttgtatttcgggttcatgagcgagcgcgcgtgcgtgttcaccgtgctcagcagatcctgggcgagcttggccgtgtcgacgtcaggcttggcggtgaacgggatcgtgaccaggcactcgttcgccgggtcgagcttctccagcgcggtggtgttgagcaccgagttcgggatcatcatcagattgccattgcgctcgcggaccacggtctgccgccagttgatgtcttgcaccacgccggtcgtgtcgttgatgctcaccgtgtcgcctggctggatcacatgcgagaacatgagcgtgaatccgccgatcgtgttcgcaatggagtccttcaggccgagtgagatggccaggccgcctatgccgagcgcggtgaacagactcgccgggctcacgccgaacaccgggtgcagcacgatggtgagcgcgaccacccagacgagcacgcgcgcgatgttgatgaagatcgacgcctgcgggatcttgttgtgctcgagcaccttgcgcaggccacggctcagcaaacgcgtcaccacgaatgctaacgcgatgacgatggcgaggaagatgatcctcccactgttcgccttcaaccagtcaagcacatgttccatgcgtaccagcgtagcgtgcggtggtcaccacatgcggaatctgcggactagcgcagggactgcacagggcggcgttgctcgctcgaatcgagtgcggtgcgcagattcgcggcgacggtggcgatgtcgggattcgtcagatcgttgggcgacagacgatgctcgatgttcggccaatcgcgcagcacgccgacgatgccgccgaccgtgaaatcgagcaggatgcgcgtgctcaggtcgatgcgatcgtaatccagatcgaaattgccgagcaacgtcaggcgaatgaaatcacgcaatgcctcggtgagctcgatcgtgctatgcgggccggcaagcagggcaagatggtcgaactgcttgcgcatctgcgggtcgttgaacgccacgatgcatgtgcgctgccattcctgccacagattctcggcagtggtggcgtggtccatgatcggtatgctttcaacggcatgcatgatcgtggcatcggcaagctcaggcaacccggagaaatggtagtagaacgagttacggttcacaccggcctctcgaacgatgtcggtcaccgtgatcttcccatacggtcgttcccgcaggagcgcccagaacgcattctccaaacgctgctgcgccggtaaaacttcggggtctcgacgcggccttggcattagaactcctcacctataaggacatgcacgatatggtggtggaataatctgcgcgatgctcatcaacactgcatatgtatgcacatcatgtgtaccttcagtctagtgttcatgagcttcatatggccggaaaatcagcttgtggcaatgctctggagcacgtttggtcgaagtcagtgcgtgaaacgcgtcccggccaggagcataatggcctgatttatgtaatggcggtcctcactgtcgagcccgacataggaggagaacagccccggaagcgctttcatgccatccgtgcgcagctgggtgatggtggagtgtccgccggaggagagcacgcggaacagcgcctccacgccatgctcgcgttggcgttgcgtcatgccgttcagccaggtgttcaacgcgccgcggaaatctcgcgagctctcggacagcgcgggaaccgtgtcgaagcggtcgccgtccataagccacgtgtagcaggaatgctgcatgaggccgtcggcgttcgatttgacgacgatcatatgttcgcgcggactcgactgcaacagcatgccgatgatggagaactccgggacgagcttggtgatgcggtcgacgatcgtgccgtattcgtaactggagacgacgtcctggttgaatccgggtgaatcgaaagcgtagatgcgttcgatgcggtctttgatctggtcgcgcgcgttcatggccgcgtagatcgcgatattgccgcccttggagtggccggtgagcatgatgcgcgcgttcggccagagtctgcccaccttttcgagatagtcggcggcctgcttttgcgcgggcaccgggtaggtgaacgccatgttgaaatcctcgcgccagccggtgagcgaatcatcggtgccgcggaacgcgacgagcagcgtgccgtcgggcagctggaacgtctcggcggcgtactgggtctgctgcgagatgtcgaaacgctcctcggcggcgctcatgcgggtgacggcgaaccgcggattgcgtttgatcgagcggtagaagcggtgcggggtctcatcgtcgtcggagaagccggaatgatgctcccaataggggtgggtgagctcgtattcgtgcagtctttcctccacctcgcgcagcgtgggtcccgggaatggcgtgcgccacagtgcggcgagcgaacggctagggtgtttgagattgaagttgcgcagcttgctggagatggaaccgaagcattcgagcagggaggagagctgcgggacctcctgcgggatcttgtcatagctcagaatcgcgtagaccagcgcgtcggcaacatggaacgggtattccgagaagtcgcgcgtctcctgcgccacgtagtcgatgatcgttgccatattgccctccgattgatcacttccatagtaggcgatgaataagtccggccgtatcgttgccagcgcaaccgggtatgggagcacgacatacggggcgtatgagacagtgaaggtatgtggcttgcagcagtggaaaaaacgtttgtatggttcctcctctacagtttcgtcggatgggtgtgggagaccgggctcaacatcgtgatgaagagacggttcgtggaccggggcatattgaatggcccgatctgcccgatctacggtttcggcgcggcgctcgcgatcttcgtgctgcacgacgagcattcgctcatcgccgtgttcctgagcagcggcgtgctcgcctgcacgttggaatacatcacctcatggggcatagagaaactcttccacatgcggctgtgggactattcgaacaagccgttcaacatcaacggccgtgtctatttgaacggcttcctgttcttcgccgcgggctgcaccgtggtgaaggaatgggtgcagcccgccgtcatgcgcatgctcgaccgcctcgacccgctctggctcaacatcgtgagcatcacgctgttcgtgatcctcatggcggacgtcgccgtgaccctcgccggcctgatcagcatgaacggcaaactcgggcgtgccgaggaatatatcaaatctgtgaagaaagagcagattgccaaaatggacgtgcatatcacggccgcagacgagcgcatcgaacagatcgagcagcatgcggaaggcgtggcgagccgtgtgaaggaatctgtatacgagcatgtgggcgtgcatgtggacggcgcgcgcgagcggatgcgcgacggcgagctcgccgagaaactgcacggcaccttcaactggcagcagcgcaggctcctcgacgcctacccagagatgaaaccggagcacggcaggtcggtgatcggcgaaatccgcgcgcaacttgcgaaatacggcaggaaacataacgcgtgacgtgggggcataggatgggtctgggaatctacggataatctacggcatagcgaaaggcttggcatgatcaacgagaagtacaaggcaatgttgggtgagaagtcggtgatccgcatgatctcggagcgggcggcggcgcggcgcgcggagatcggcgccgacgaggtgttcgacttctcaatcggcaacccgagcgtaccgtgcacgccggcgttcacgaacgcggtgatcgacctgtacgagaacgaggcgccgagcgcgctgcacggctatagcccgtcggtgggcatcacatcgttccgcggcgccgtggcggactcgctcaaccgccgcttcggcatggactacaccgagcagcacatcttccccacgtcgggcgccaccggctcgctcgcgcacgcattccgcgcggtgaccaagccgggcgacgaagtgctcacgttcgcgccgttcttccccgaatacatcccgtacgtggagggcacgggcgccacactcaccgtggtgccgcccgacaccactgcattccagattgatttcgaggcattcgagcgtgcgctcaacccgaacgtggcggtcgtgcttatcaacacgccgaacaatccgtcgggcgcggcgtactcggcggccacgctggagcgtctggccggcattctgcgcgacaagcagaccgaatacggccacgacatcttcatcgtgagcgacgagccataccgcgagatcatgttcgacggtgctgcgcaggcatacccggcgaagttctacgacaatacgctcacctgctactcgttctcgaaatcactctcgctgccgggcgagcgcatcggctacgtggcggtgaacccgcgtgcgacggacgcggacgtgctcgtgccgatgttcgcgcagatcagccgcacgatcggacacaactgcccgagctccacgatgcagctcgcggtggagcgtgtgatcgacgacaccagcgacctctccatttacgaagcgaatatgaatctgctgtacgacgcgctcgtcgacctcggattcgaagtggtgcggccgagcggcacgttctacatattcccgaaggcgctcgaggaggatgcgaacgagttcgcacgcaaggcgatggaatacgacctgttcatggtgccgtcggactcgttcggcatgccgggctatctgcgcctctcgtactgcgtggagaccgagcatctgagaaaggcgatcgtgcgcctgcggcaattcgtgacggaggtgtacggcgagcgcgagtgagcgcggatctcgtggatctcgcggatctcccggatcttgcgaatctcgctgcgtaacctctccgctgcctaccactccgctgcgtaatttgggacagattagggggtgaagatgtccctttttacgcagggctacgccgggggatgcgtgcagggcattggctcgctgtgatccatgtgtttcatttgcgtaaaaaggatcatttgggacgcgcggatgtccctttttacgcaggaaggggcgcagattggggatcagttggcgggacgctcggaggcgagcacggcatcctcgtcgagcacaccgaaacgcaagctctggcgcagtgcacccagtcggtcgtcgttgctcaacgcgccaagcgcccacaccgcctcgtcggcggcgagcgggaagccggcgtcgacgagtctgatcgccgccttggcgagcagctcagtctgtgaggtcagcggcgccaccggaatgccatgcttgttgagcgtgtgcgtcaccgcatccatatccggcagcgaatccacgcccatctcctgcatgagctcacgcacctcgacctcggcagcctcctcatactgcgcgtggaaccccatgcccaacatgaacgcgtagcaggcgagcgccgcctcgcgattgttggtctgccacagcgaataggcaagacggtaatacatgaagttcacgtcgcccggcatcaccgccaccgcaagaccgcgggtgagcacgtccgcgcccttcgcatggtcgccggcgatgtccacataggtgatcgactcgtcgacgaacggctgcgcggtggtgggcgcgagcgcgagcgcctgctgcagctgggcgagcgaaccgtcgaggtcgccggaatcacggtggatgcgagccagcgcgatatgcgagttgtacagcgcgtcgggagccttgacgtagcgggtctgcggcgtgtggtcgggcagattcgcgacgagcaggcgcatgagcggatgctcgcagtacagcggcttgcgctcgccgagatcgggcatctcgctttgcagtcccatcagcgcggattcaatctccagcgaggcggacatgggagagtcctcgttctgctcggcaatctggaaaatctcaccgcccttgatgctcgcgccgtcgtacatcacatcgaggtcgcggccgaaatcggcgcccagcagcgccttcagatcgtcgggcagctcgcggtcatcgcgccacagcggcacacgatgcgcgaggatcgcctgtgggatcggcagcgcggtgatcggcgtgagtccgcggtccgggccaaaggagatgacctgtgcggaagggcgcagcatctgcagcacggcagccgggtcgctgtcgagcgcgggatcgttgaactggccggccatgaacgcgggcaccgtgcccatcatgaacggcgtgcgtgtgaacgcgagcgagagcacgggcgcgccggtgaccgatccgagcgtgccgttcaccgtgagcgacgtgatgttcgtgcccgcggtgaacgcggcctgcgcgatgatgccggcgagccgcagcgcgtaggaggcggcctgggcggcgcgctgctcgcgaatgccgacccagccggagtcggtgagcacgctggcgggcatcatcagcgacgtgggaaccgtgaaattgacgaccatctcgccggtgtcgggattcgcatcgcagcggtactccacgcggtacggcagaatgaggcgttcgcagatgtctacgaaccgcgacatgacgtcccacatgccaccgcgtgcggccgtggcgccacgcacggtgagattcgaattgcgggcgtcggcgcgcgactggatgaacgaggtgtgcgtgtcccactcatgcaactcgtcgaagccggcgcggtaatcctgcgcctcggtaagcgtggtgaccaagcccatgccgttgtcatacttggcggcgatacggctggcggcggcgagacgattcagcgcgccctccaccgagagcacgatgtcacgctgcagaccggtgatctcgttgcggttgaaacgcatccagaactggccggtgctgtcgagttgcacgacgtcgagattgtgctcggcggtgatttcgcgaatctggccggctcccgcctcgatgagctggcgtgcggcgaaccgctcgaacgggctcgcggtgttcgaattcgtggtgccgcgccagatgatctcgtcgagcgcgtcggcgagcggcttgttctgcatattttggaagatttcaacgatgcggccggcgcccatgcccagctgttcgccgcgcagcttcgggaagtgggcagcggcgagccagaatgcggcgagcagcgaattgagcgggtgcctggcggagccggtgttggttgcgtgtgctggggcggctgagttggttgcggcggggccgtacgggccgagatcgacagaggaggcggtggcgatgccgttgagcgagccggtggaatagccgctacccgagaagtcgagctggagctcgccgatcgtgatggtgcggttcagaccgtcgttcgactggatgcgcacggcgccgaggttcttctggtcggtccaggcgtcgaaatggagttcgccttcgacgtcgttggtgctcgggtcgttggtgagcggcacggtggtcgggtagaccttgaggctcttggagatccaggcgatgatctgcacctgtttgttgttctgcttgccggtggcgggatcgtcggcgaaacgcacgatgtagccgagtccgttctgtggctgcgagacgtctttgagccgcatgacgatgccatagcgcgaattcgtggggtcgcccgggatgggcgcgagcctggaaaccttcgccaggaaggggagctggtaggtttgcactgactggttcgtgggagcggattgcccttggccgccgacggagactggggtgaccggcgagaatggatcggttccaaggccggcggcgctctgcgcgctttgtgtgctctcgggattctggtacgggttgcccaatggttcctgcatgttcctcgtgtcctccggcatcagcgtcggcatcgcgtgatgtgctgcgttttcggattcggtttccgtcgtctgtgcgatatatcgcgtgatctggtggaatcgtagcatgttcggcacggcgcatgccggattgttccatatccgtgagcgtgcgcattcgtgcgcacatgccgccgtcggtgtgctgagtaattgtggagacaatctgcgtaatttgggacagttggacggctatttctgtctctttttacgcagatacgcagagtggcggcgcgcatattcgagtctgcgtaattcgggacggttggagggttggttctgtctctttttacgcagaaggagaagcagaagaagaaggagaggctgggaggtgagaaacagggggaggctgcggggtgggaaatctgcaaatgcgggcacggagatgtatgccgcggggcgagtggtgcgtatactgcgtgtcagtgaagcaatgcaaagcaggagtaggggatatggcagaacaagagagtgcgctcgatttcattgaggcgacgcatctgtggtcgcagcacgcgcagttcgtaggcagggcggagggcgcgccgaatccgttccgcacaatctacggcgtcgaagcgcagccgggcggcgtgtgggatgtgatgacgcggttccacacaatctgcgaacggttgcaattgccgttccacgtgagcacgagcgtcgaggtgaacccggcgaccggcgacatggcagtggcattcggcgcgcccgagccgacgcagttccccaccgcggtgccggattcgcacggtcgcgcgcgcgactgcaccggcaagcgggcgcagtggacggcggcatatgcgttgcgcttggcggcattgctcgcgaacatcggattcgcggtgaacacgggaatcattggtgtcacggtgatcgcgcgcgccggcgaaccggatggccagacgctgttctcgctcgggttcaaccgcgtcgacttccatttcaccacggccaagctgtttgcggacggcacgattgatgacgcccagttcgacgtcgaccccgcgcagctgctcgccgcgttcgacgtggacagcgcgcgtgtggagttcgacgccgacggatggttcgcgccgacggaggatcccgagctgccggagtcgctgtgtgaactgcgcacgccactcggcgaggacgcgcgcgagttgccggattcgctgaagagcctgctgcgcgccgaccgcgtgtgcgatctggacattgcagatcaggcgagcctgagcattcgcgacattcaccagatcgcccaggagaacgcggattcgccggtcaccgccgtggtcgagctcggcggggcgctcacgacgctcaaacaggagctttcggtgagcacgtccattcgccagccgctgtactgcgagcgggaggcgttgcgattgctggtctccgaggcggcgggtgatgcggcgacgcggtaccgcacggtgccgggtgcaatcgccgcagtgcgctccgagctcgcgcgctttgacatgaagcttggtcaactggatgacgcactgcgcgaactgcaggaactgcagcgcatctcgcccaccagcgtgcagggcggcatcgccgaggccatggcgtattcgatggccggcgacacggcccgcgcggtggacgccatccggcaggccctcaagctcgccgtggtgcccgacgaggtggcgttcctgtactgcctgctcgggcagatgttcgcgatggcgggcgagaccgacacggcgatcgacgcgtactatgtggcgtccaccgtggccgcgcagaccgcgtacaccggcgtcgcgcgccaggcgatggaggcgttgctcgcgcagattggctccgcggacgacgacggcgagcgggacgagcgcagtttcaccgcgacggtggacgcgcggcccaccgcaccgtcacgcgggcacgcgctcggctcattgcaggcggccggaatcccgatctcgccgacccagccggtaatccagacgctcacgcgggcggccatgctgctcgccgatgccggcgttccgctcgccgcctacgacggtgtggagattctcgccgagtattccgcggaaccgacgctgctgtggatgtgccgcgcactgcaggaaggcgccggctgcgcgcgctgaccggcgtcagtcggcgtgctcggcgtctttgagcgccttcgtgaccaaggcgaccgcctcgtcgtaggtggggcattgcggcacgccgttgatgcccttcgtgattgcgatcgacgcggcggcgttggcaatctgcacggcgctttccagattccacccattcgccagcagcgcgcacagcgcaccggtgtgcgtggggccggccgagcgaatatgcgtggccttcgtctcgaatccgtcgatgtgctgcaccggttcgccatgccgacgcacccacgcgccgcgcgaaccggcacgcagcacaacgggcgcgcgcaagacatcggcaagcccgtcgcacagcgcgctcatcgaatcgtcgaagccgccgtcgacgcgcatggtggccgtctcatccacctcgatgccgagccggtctgcaatcgcgcgcccctgctgccgattgagcacccagatcgggtgcagcagcacgatgtcttcaagcagacgctcgttcaccgtggacatcatgctcgtgggcgtgagcacaatgcggaagtcgcgcacatccggcgcgcattcaggccgtgagatgaacgatcccaccgccaccgcgcccgtgttcatcaacgatgcgccgctgatgtgcacgacgtcgccggacttggggtgcatgtcgtcgaacgtgtgcgcgtcggtgcgcacctccgcgccgggagcagagatgaacgagcgttcctgtccgtcgttgatcaccagccgcaggccattgtcgagccccttgttcgtgatgccggtatgcctcacattcacgcgtttcaatgcgcgacggatcatgtcggaccacgggccggttccgaggatgcccgcgagctcggtctgcgcgcccatgcggctcgccgcctcgagcaccgcgaaactgccgttcaccgatctcgcgatgctctccgcgttcatgaacgagcccggtgccgggaactcgggaaccttgatcatggaatccacccacacctgcccaagtgagatcacggtgggctcgtggtcgcgtttcgcctggatcgagtgaagaatatcgctcagcatagcaccccttttcttgattctgccgcttcgcagatctcgttatgcgcgattctacccgacaatctgagaactcgctgaaaacgcggcagaccgcggtgaaatgcccggtctgtgcgcagtgtggtgcacaaagagaatcatgggcttgcgttgtcggcacggttcatgtaatattgtgaagttgcgtgttcgactgtgcttcgtgtatgcggagcatacgggcatgcagacttgcaagtcaatagtaatatagggagtccattatggcagctcgttgtgcagtgtgcggcaagggaccgcagaccggttataccgtttcgcactcgcatattcgcaataagcgccgcttcctcccgaacctccagccggtgcgtaccaccgtcgacggccagaatgtgcgcctgcgtgtgtgcacgaaatgcctcaaggctggcaaggttcagcgagtgaaggttgcgtgagcgtaagcgatacagtgacaagaccccggtgagttcggctcccggggccttttcgtatgtgcgctcctttctctgcgtaaaaagggacaggcaggggcgcttagatgtctctttttacgcaaaaataggacgtaattggggacgtttagcgcacctaatatgtctctttttacgcagggaaggggcgcgggtttcgcaatctgcgggcgtgggatagactatgacaacaaggaggcggcaatggcacggcaggacggtacgcgcgacgtgacgctcgagacgccgctgcacgctctgctcgccaacaaacgtcgcgtgagcgcactgaagaagctcggcgtgctcgacgtgcgcgacgcgctcacgtattacccgttccgcgtcaccgatcccgtccccgtgcgcgcgctcgtgcaggcccagcccggtctcaaggagaagatggcgtgcgccgtgcgcgtgcgcagcgtgcgtgtcagcccgatgaacgcgcgcgccggctaccgtgtggaagtgctcgtcgacgacgacgagttcgccgcgacgctccatgtgcgcggttcgctggccacgctcgtgttcttctcgcatcgcaaatcgtacgtggactggctcgccggccgcttgcgcgtcgacggccacgtggtgattgccggggatccgaccatgtatatggaccgtctgcaattcacccaccccgaactgctcaccgtgggcggcgcgaatctgcgggccgatgtgagcacggtggccgagggtctgcagcgcgtctgccggccgcggcccgtctaccatgcgaattcgcgcatctcgagcgagcatattcacgacacgatcctctatgtgttgcgtctgctcgccggcgaggacccggcgaccgcgatgcacgccgacgacgagaccgcgcagccgcacatgcgcacgctgtatgcggaaaatccgcagattcgcgagcatttggatgccgcgatcccggacattctgccggggaatctgctggccgagctgaatctgatgcaccgcgcgcaggcattctcgcagattcacgacccggactcggtgggcgcgttcacgcaggcgatcacgacaatgcgctacgaggaggcgttcgtatgccagaccgcgctgatccgcgcccggcacgatgcgcgcgagcacaacgcgtacgtgtgctccgacgtgcaactgcgcgacgaatacatagacacgctgccgttcgtactgacgaaaggccagcgggaggtcgtcgacgagatcagccacgacatgtgccaggaccacccgatgcagcgcctgctgcaaggcgaagtgggctcgggcaagacggtggtggcggtgagcgcgatgctgcaggcggtcggatctgggcaccaggccgtgctcgtcgcgcccacgcaggtgctcgccgagcagcattaccaatcgatctcgaacgtgttcaaccgcgcgcccgtgctgctgctcaccggcggcatgaagctcgccgagcgacgcaaagtgctcggcacggcggcaagcggggagccgtgcatcgtcgtggccacgcacgccgcgttctcgaagtcgttccaggcaccgaacctcgcgctcgcggtgatcgacgagcagcaccgcttcggcgtggaacagcgtgaaacactgcgttcgaagtcggacgtggacccgcatctgctggtgatgacggcgacgccgattccgcgcacggcggcgatgacctggttcggcgacctcgacatctcctggctcaccgagttgccgggcgggcgcaagccgatccagaccgtggtgattcccgaagagaacgcgccgctcatggccgagatgttctggcatattcgccaccgcatagacgccggcgagcgcgcatacattgtgtgcccgcgcatcgaggagtcgactgaagacgccgagggaggggaaagcggcggcgatgcgcgcgccgattccgacgacggcatgctgctcagcgacgaggacctcggcgagacgaacgcacgtgcgccgctacattcagtgcatgagatctccgagcgcctgcaatcgctgccacagttccaaggcgtgcgattctgcgaactgaccggccgcgacgacgacgagacgaaggagcgcgtgatggccgaattcgccagcgggcagacgccggtcatggtggcgaccacagtaatcgaggtgggcgtggacgtgccacaggcgagctgcatcgtgatcttcgacgccgacaggtacgggctctcccagctgcatcagctgcgcgggcgcgttggccgtggcggcacgcacagctgggcgttcctggtgtcgcaggctgagccgaacagcattgccgagcagcggctcgacgtgatcgcgcattcgctcgacggcgcgttgattgcgcaaaaagacctcgaattgcgcggtgccggcgatgtgctcggcgatacacagtcgggcggccgctcgagcctgaaactgctgcgcgtggtcaaggatgccgccatgatcaccgatgcgcgcaagcgggccgagctgttgctggatgccgacccgacgctcgagcaccatacgcagctcgcgggcgcggtgctcgatttctcgcgcggcaacgagaagttcctcaccagcaactagtgcagttcggcgcagttcgatgtagttcgacgcagttcgcagattcagctcgtgcgtaattggggacagttatgggcaatttgatgactctttttacgcaggatggtgggatatggtcgttttgttgtgcgcgtgtataggaatcgaccaaagattgacgatctttcgtcgattgccagaaggcacgcggcagatgacgaaagttggggggatgggtttcgtcatctgcgagtgaggggtggagatgcgaagaaggtggggagatttggtggggcgatgggaaaatgtggacacagaaatgagatgtcggtgatttgtatacgtttcgctgatagcatgtatatttatatataagtcaggaaatcgttggtgacgcagggattgtttgcttcgggcgaattcttgactgccagatctctgcggggaggggctcatattagtgcttttcttctcagggagatgcgagaagaaaggcattgcaatggacatacggcagttgcgcgagtgggggaagcgactcttcggctccataagcgcaaatacgaagaaggccatcgccggcgtgatcagcgcggcgatgatagtgaccgtggcgttggtggcgatcccggcgcaggcggcgggaaacatgatcgccgacccgacgacgttcacccagtgggagcagggcatcggcgagccgaccgacccacgctccaccggacgcgtgtggaccgacaagtcggtgtctacccaagaggtgacgctgaagacatatgacgacaatcacgtgactgtcgcaccaaaggacggttcgttccttgtcggtctttcggcgatgtcgagcgcgcagaagctcatcggcgtctcgaatgtgacgaaaccgttggatatcgtgctcgtgctcgacacctcggggtcgatggcatggggcatggatggcgatgatgagtatgcatatgaccccgtatatgcggccgacatcaccaccagcaaacggtactacgttcgtgtcagtggatcaatgacacgcgtttatagttcagcaaacggctggtactacgacgcaggaggcagcaggcattatgtgactccgaaaacatccgccgccgacagtgacgccgcgcatacgcagttctacagccggcggaggctgacgactcaagacacgcgcatgtatgcgctcaagcaggcggtgaatggctttatcgaccagacgattgcggcgaacgccaaggtgagcgacccgaacaagaagaaccgcatcggtctcgtcacctacgcgagtgacgtaaatacgcgaagcggcctgaccgattccctgagtggcctgaagtctaccgtggacgacctgaaggcatccggcgccacacgagcggatctgggcatgcagacggctaacaccgttcttggcaatgcgcgtgccgatgcctcgaagatcgtcattttcttcaccgatggccagcccaccaaatcaaatggttttgagaacgacgtggccaacgatgccatcggcgcagcgaaaacgatgaagaccaatggcgcatcggtttattcggtaggcatcttcacgggcgctaatccggatgccaatgtgtcgagtgtgaccggcaagagcgatattgagctcaagtcgaatgcgttcatgcagggcgtctccagcaactacccgaacgccaccacctataccaatctgggtgccaaagccccgaattcaaactactaccttgccgcatccgacgccgatacgctcaatgccgtgttcaacacaatctggagcgaggtctcgagcaacccgacctcaccgatccaggccgaatcgcaagatggcacgaccggtgagcggaaaggtgcggtgacgttcaccgatcagctcggcgactatatgaccgtcacatcgatgaacagcgtgatcttcgcaggaacgaagttcgcgttcgatcccgacgccgagaacgcggtggtcaagaacggcaacacgaccacctacacgttccacggcgaagtcgccggcaatgaggtctacaaggccgcgaatctgcaggacctgaagatcaccgtcaccgacaacggcgagaagaccggcgacaccgtgagggtggaagtgccggcggatctgctaccgctgcgcctgtacacggcgaaggtggacaaagacggcaacgtgacgacgagcatcgcacgcacgcacccgatccgcctgttctacgacgttgcgctgaaagacggtgtgcgagacaaggtggccaagccggatgcggcgatgagtcagtacatcgcacagcataccgacgcgagcggcgatgtgtacttcctgacgaacgcctacgacacgtcggcacaaccggcggcggcgaacggtacgacgaccgccgtgttcacgccggcgacgacgaacgacttctactacttcacgcaggacacgccgctgtacaattccaagaatctggaagacccggcgaagtccatcgaaaacagcgtgacgaagacctactactaccagcgcacgtactacgcgaacaatgcgaagcacgagcagtggatcgacgtgctcggcagcaacgcgtacggcaaggcggttgcggatagcaaggggaattactatgctcccgcaggcaccgagcgtaccggactgtcgcgtctatacacggctccgaagaaaccgaacacgaccaacaccgcgtcgaatgcgatcgcgccggaatggcagatgaacaatgtcaccgtgcgcctcggcaacaacggcaagcagacgcttgccggagttggcacgctgcatgtgacggagaaggttgtgtggccgcagggcgcaaagcgtgacccgaacaaatcgttcccgttcacactgcagctcgaaggcacgggtgcggatggcgaattccaggccgtcattgccggggaaggcatgaccgtgacgaatggacagacgttcgagctcaaggacggcgaaagcgtcaccgtgtatggtctgacgccggggctcaaagccacggtggagcaaaccaaccatggcggagcaggctggagtgtcaatcatgccaatgattccggcacgatcgaaaagaacaagacgaccaatctggacttcgtgaacacctatgcgctcacgccgacgacgcttgcaactggttcaatcaagggtgagaaagtgcttgccaatcgcgattggcagccgggtgaggaattcacgttcaccatttcgccgcttggggagaattcgaagaatcctctgcccaacccagcaaccgtgtcggtgaagaacaatggcagctataaggccggccaaccatacccgttctcgtttggtgggattgagtattccaatcccggtacataccaatatgtgataagcgagaatccgggtgacaaggcaggcatgcagtactccggtgcaagctacaccgccaccgtgaccgtcgaggacaacggtaatggcacaatgaccgcttcggtcaacatgaagaagacctacaacgaccagtatgaagcagtcaacccggcagagcctacggattacgccaggttcacgaacaggttcctcggcaagaacgagtccgcaccaattgttaacggctacaagaactacaccgaccaaacgggaggcaatccgaatgaggacggcaagttcaaggtgattattactgctggtaataacccggacaatggtccagccgttcccacccagcccgtcgacgtgaaagcagatggcacttggagctggaacccgacattcacgaatgccgcactcaacggccagaccagccagaccttcacgtaccatgtgcgcgaggatgtgccgacaggtgcaagcccgacgctcaatggcatgacgtatgacctcaacacgtatgatgtgacgatcacggtgagccgcgattcaaaccaggatctcatcaccacggttgggtacccgaacggcgcgaagcgcatcgagttcacgaacacgtataaggcaacgccaacgcagcctcagacgttgcaggtggaaaagaaagtcaccggacgcgatgccgaagcccgtaagttcaccttcgaggccaagctcgattcgggtgatgccaataatgtcaagatcaataacaacgacaccctcaccaattgggacaccatgacggtgaagacgcccgagatcaagaacggcaacaccaccgacatcaacttcgaaggcattgtattcacgaagccgggaacctatacgttcggcatctccgagcagatcccgaacccggtgcctgccggctggacctacgacacgcacacgcataccgtgacgtacgaggtgaccgacaataacggccaactcgaagccaggcgcaacactgacggcaacgacctgttcacgaacgcgtacgccgcatcggtggattacggtgccgaaggcactgccgacggattccgcattggcaagacgctcaccggacgttcgatgaacgccggcgagttcgggttcatcatcgagccacagaatggcgccccgatgccaggcggtgcggcgcatgcgacgacgaccaacccgttctccgcagtcagcgggcaggagctcgtctggccggcgaatggcacactgctcgccggactgcggttcacgcaagacgacgcaggcaagacctacgagtacacagtccgcgaagtgccgccggaagacgtgacacaggaatcgccgacgaagaacggcgtgacctacgacttcgccgcgcataaggtcagcatcaaggtcatcgacaacaacggtgacggtacgatgagtaccgaaacgactgtggatggctccactgacgctatcgcgcacttcacgaacgagtacgcagccgcggcaggcagtcagtcgttcaagctcgcgaagacggtgaccggtcgtgactggaaggacggcgaatcgttcaccttcgatctgacggcgaatccggaccagtccaatgtgccggaggacgtgttgacgaaggcgatgcccgaacggaagtcggtgacggtgggcaagccggagaacggcaacaccgcccagttccacttcgacgacttcaccttcagtcaggccggcacctatgtgtacaatgtgcgcgaacggaacgccggcacaacgacggacggcatgacgcatgacggacgtacggcgatcgcctcgttcaccgtcgtcgacaacggcctcggccggtatgtcgccggcaaaccgcttatcaccggcatcggcgagtcgaacaccttcacgaatgcctacgaggctcagtcgttcgacggcgtgccagacggtatggaattctcgaagcagctgacgggcgtcgaatggacagctgatcgcgagttcgagttcacgctgaccggcaaggacggcgctccgatgccggatggcgcgaaggatggcgtgttgacgaagaccgtcggcaagccggattccggtgatacccagaccttcgacttcggcaacatcaagtacgagtccgccggtaagtatgagtacgaggtgaaggagacgaagggcgatatgcccggagtcacctacgacgagcacccagcgacggtgaccgtgacagtgaccgacaacggcaagggacagctcgaagcgaaggccgaagtgaccgatgccgcattcgtcaacacatacaaggcgaatcaggtgacggtcggttcgaccgatctgaagctgtcgaagcaattgacgggcattgcgtggccgaaggaccgcacgttcgagttcacgctgaccggcaaggacggcgctccgatgccggaaggcgcgaaggatggcgtgctgacgaaggcggtgcacaagcctgccgaaggtgatacggcggacgtcatattcggcgatatcacctatgacaaggtgggcacgtacgagtacacggtcaaggagacgaagggcgacatgcccggcgtcgcctacgacggccacacggcgaagatcaccgtcaccgtgaccgacaatggcagaggcaatctgcaagcagaagccaaggtgagcgaatctcagttcgtgaacaagtactctgcgcagccggcgaccggtgtgcccaccgacttcacgctgcacaagcgcgtcgacggcatggcatggaacgagaaccagcagttcgagttcacgatccagggccaggacggcgccccgatgccgaagaacgccaccgtcaccgttggcaagccgaccgacggcgacaccgcgagcttcgacttcggagagatcgtgtacacacgttcgggcgtctaccgttacaccgtcaccgaaatcgccggcaaccagccgggtatggcgtacgacgggcacaccgcgacgatcaccgtggaggtggcagacgacgggcaaggccatctcgtcaccgccaccaccgtggagaacggcctgttcacgaacaagtacaccacgcagaacgtggcgtatccgggcgtcgacgtgaccgaggagctcaccggacgtgcgcaggcacagggtgaattccagttcgtggtgcgcggcagcgacgaagacatgcagcgcgccggatacacggcacgggcacgcgcggtgtcgggcgtctacgaattcgacgcggcggccagcggcgagactgtcaccgtgccggggctgttcaccggactcgaactcacgcacgacgacgttcgttcgggcaggaagttcaacttcgaggtcgaccagattggcgcgcagtccggcaacggactgaccgtggacgagcaggtctacgccgtgcagatctgggccaccgacaacggcgacggcacaatgcgcgtgcacacgagtgtcaatggcactgaaaccagcgagaagacgccggtgctgccgttccacaacgtgtacgcgacggcgccggtaacgattggcggtgaagcgccggtgcgcatcaacgcacacaagacgctgcacggacgcgaccttgccgacggcgaattccacttcgccgtgcgcgacgccaagggcaacgtgatcgccaccgcctctaacgatgcgaacgggaatgtggacttcactccaatcgagttcactgccgagcgccttgccaacgacgtgcagaacggcatcgccattcgcaatgtcgattacacgaagacgccgccggtgactacgtacagctacgaagccaccgtcacggaggacgagcccgacccgacgagcggcgtgaccgtgctgaatggcgagttcagcatcaaactgatcgtcaccgacgaaggcaacggcactctcagtgcccgcgtagagtacccggccggaaccgaccgtcttggtttctccaaccagtacggcgcctcttcgaagctcagcaagccgatcatcggagccaagaagctcgacgtgaagtctggcgacaacgctccggagattgcaggcaagtacacgttcacaatcagcggttcggaaggcgcaccaatgccgaagaacatgcagaccacgaacgacgaagccggcaacgtcaactttggtgacatcgaatacaccatggagaacgtattcggaaccgacaaggtgcgtgagaagacgttcacatacaccgtcacagaggaaggcaatgtgccaggcgtgaccaacgacagtgccaagaccttcaacgtgaaagtcagggacaacggagatggcaccctcgccgtggaggacagcgaaggcatgcccttcacgttcaccaacatctacgccgtgtcgccgaccgacccggtgtcgccgaccgacccggacagggaaggtgtcgtgaccggtggcgtgccgatgacgaagaccatcgccggtcgtgacttgaaggacggcgagttcgaattcgccctcaccaaggcggacggcacgcttgttggcaccgcgaagaacgcggcagacggctctgtgaagctgccggcagtcacgttcgacgcccctggcaactacgcctacctggtccgcgagaacgccgctgacgccgacaacggcgtgacctatgacaaccgcacctatgcggtggtcgctcaagttaccgacaaaggtgacggaacccttgcagtgcagtggcagattgccgattccgatggcaacgccgtgaaggcaatggctttcgagaacacgtacgccgcagttccaactgccgttcagttcggcgtgggcaagttgctcgacggtcgcgctccgcgtgaaggcgagttcaggttcagtctgcgtggagccgatgaatccaccccgatgccgcttgcggcagttgacggtgtgcagacggtgaccaatgacgcaaccggtagcgccttgttcggcaccattggctacgagaaggctggggaataccactatgtggtaaacgaggtcaagggcgatgacaagaccatcacctacgacgaccacgagtacgacgtgaccgtgcgagtgactgatgacctcaagggcagcctcgtggccgcggtcgagtatccagaaggcgtggaaggcattgtgttccataacgtctacaccaagcccgttgagccgagcaagcctgccgaaccggcccagccggctaagcctggggccaagccggaagccaaggaaccggcgaaggaagtgcaacaggtggccgacaccggtgcggacatcgctctcgccgtggctgcagcggccgcgctcatcttggcaggagccggtttgctgattgcccgtcgccgcaacgagtgagctgctgaccgggaatagctagtccgagccaacactgaggcccgcaacgccattcgttgcgggcctcagtgtttttgggctgtctgtggggtctatcggtttgccaagctggttcggcatggttgcgcgtgcaggttcaggtacaagggcgtgcttcgcattgctggtggcgctatggcgttcaggttgcttggtggttgtggctcgtagcggcatgcacagcttgatgctcgcgacgtcgtgggacgagctgctgctggacgccgatccgatgctcgatcaccatgcgcaattcgcgggcgcggtgctcgatttctcgcgcggcaacgagaggttcctcaccagcaactagtgcagttcggcgcagttcgatgtagttcgacgcagttcgcagattcagctcgtgcgtaattggggacatctttggtggccgatctgtccctttttacgcagatacagacagatcagatatagctgtacatacgcaacggatgcagatgctgtgcgtaaaacgggacatgtggacgctgaatttgtctcttttcacgcaaagaacatcatgcagaatgcttggaaaaataagacgtacaaggggcgtgggaggcacgcatgcacgcctgcggcgagagggcgggataatctgaagacatgcgtgtgattacaggacgattcaagggcgtgccgctcaccacgccgcgctcggagacgcggccgaccaccgaccgcacgaaggaggccatgttctcgcgcctcgacagcaccggcattctctcgggtgcgcgcgtgctcgatctgttcggcggaaccggcgcgctcggcatcgaggcgctgagccgtggcgcgaacgaattggtggtggtggaggcatctggccccgctgccaagctcatagcgcatacgctgacagcactgcggcacaatcccgcgtgggaggagtcgatgaacgcgcgcatcgtgcacgcgaaagccgagcggtacgcggcgaaggcgaaggtgggcgagccgttcgacgtggtgctcatcgacccgccgtatgcgttctccactgccgattgcgaacgtctgctcggcgatctcaccgcgcgcggcttggtggcgcgcgacggcatgatcgtgctcgagcggtcggtgcgcaccgagcgacccgaagcgcccgtcggatggcagatcaccgacgcgcgcgactacggcgagaccgccgtgtacacctaccgcgcgcagtgagagtgcagtgagggcgcgggtgggcgtcagtcttcgagtttgcgcggatgctcgccggagacctcccagccgagcgacatgagcgtcttgcggtcctgcttgtcgagcgcgtggcagtcgagccgcgcaatgaggtcggggcgcagtcgggacgttttctcgagggcctcgtcgcggcggaatctgttcaccctgccgtgatcgccggagatgagcaccggcggcacgtcgattccgcgccagctcgccggtttcgtgtactgattgtgctcgagcagtgcgttctcgccggtgtatgattcctcgacaatcgagtcggcgtttcccatgaaaccgggcagcaggcgcgtgatcgcctcgagcatcaccgagacggcgacctcgccgccgttgagcacatagtcgccgatcgaatattcgcgcacgtcgacgccgcgttcgcgataatactgcgggatgcgcgcgtcgtagccctcgtagcggccgcagccgaacacgaggtgttcggcgtgcgacagcgcggtcgcgtcctgctgcgtgaacagcggggcggacgggttcgggaagatcagcacgggggagtcggcggccggggcggcgtgcgcgttcgcgggagcgtcggccgggatgccgagcagctcgtcgaggcattccgcccacacctcgggtttcatcaccatgcccgcgccaccgcccaccggggtgtcgtcgacggactgatgcacatcgtgcgtccactgccgcagattatgcgagcgcacggcgagcagacccctctcctgcgctttgccgagcagactgagattgagcacgtcgaaatactcggggaagacggaaacgatgtcgatgtccaaacgaactcctttgaaatgggcagtgggtgggagagcgggatgcggtgggcttcccctctgcgtaaaaggagacagataggtgctggtagatgtccctttttacgcagagaatagggacgtaaaaagggacggatagcggttgcaaatgtctctttttacgcagaaggaggggccgcgccgaccgagtctgccgtgtccgcgatgtctggctcgccgatgccggggacgaggccgccgggcggatccacggtgaggtagccctcctcgagattgacctcgggaaccagcgcctccacgaagggcagcaggaaggcctcgcggttcggcatgcggatcttgagcagccattgggcgccctcgatcacgtcgaccaccttgccgagatcggtgaactcgaattcggcgccttccggggcgtcgtcggcattcgccgcggacacctcggattccaggtacacttccaggccgagcagatccttcgggtagaactcgtcgtcatcgagctcctgcggctcgccgtacagcacggtgttgcgcagcgcctcggcggcattgcggtcatccacgccttcgaagcgcacataccaacggttcttgaatgtgcgcgcggcggccacggtgtaggggcgtagtgcgtccgcagcggattcgcgcgcatagagcacctcgccgggtgcgaaacgggcatgcgggtcgtccgtatacagttccacggagacctcgcccttgagtccctgagccttgccaatacgacagacccgcaacaactcttggggctgttgcgggtctggcacgctgttcgtgtgcatgttcacttgcgtacgtccatgatgtccacgcgaaccttgtgatcggagatcgcctggatcaccgtgcgaaccgcgttcgcagtgcgtccgttgcgaccgatcacacgcccgatatcctccggattcacgcggacgcgaatcagttcaccgcgggcgttctcatgggacttgactgaaacgtcgtcgggaaaatcgacgatgttcttgatcagatgttccacggcttgagcaagcatggtctcacacgctttccggtgcggattcttcgacgtcggcgagctcgaccttctcgtcatcgtgctggacctcggccggggtctcggcttcggctgccttggcggcggcttcggccttggcggccttgagcttctgcgccttgttctcagcctcttcgacgagcacggcggcttccggcttggcggcggcggtcttcagcgtgccctcggcacccttgaggcccttgaacttctgccaatcgccggtgatcttgagcaggttaagcacctggtcggtcggctgtgcgccgacgccgagccagtactgtgcgcgatcgctcttgatctcgatggtggaaggctgcgtgttcgggttgtacaggccgatctcctcgatggcgcggccgtcgcgcttcgtgcgcgaatccatgaccacgacgcggtacaccgcatagaacttcttgcccatacgcttcaaacgaatcttggttgccaaagtggctctccttgttaactagggtgtgtgtttcgccggtcgtgtggggacaggacccgctcacacacgtgttccttgcacatggggcatgagagggctccccgtgcacaaataacttcactagtatagcgtgcgggggtagataatctgcacatgggcgtaacccgcggaaataccgtgctccccataccatgttctcataacagcggtggaggcaaaggagacggccgtgttcattccgcggtatttcgaggatcttgatacgttgcatgtggggtgcgagccgaatcgcgcgtatttcgtgccggcgtcggcgcccaccgatacgcggttcgccgcgcgcgagcaatccgatcgattccgtctgctcaacggcgagtgggatttcaaatactatgcgagcgtctacgatttggacgcggaggtggacgcaagcgctcaagctcacgagccggtgttcaccgaaccgatgttcgacgcggactcctatgaccagatcgccgtgccgagcgtgtggcagacgcacggctacgaccacaaccagtacacgaacacgcgctacccgttcccgctcgacccgccgttcgtgccgcacgataacccgtgcgcggtgtaccgcacgaccttcggctatgacgtggatcccgcctgcccgcgcgccttcctgaatttcgagggtgtggacagctgcttctacgtgtggctcaacggcgacttcgtaggctattcgcaggtctcgcattcgacgagcgagttcgaggtgactgacgcgcttgacgacggcgagaacacgctcgtcgtgctcgtgctcaaatggtgcgacggcagttacctggaggatcaggacaagttccgcatgagcggcatcttccgcgatgtgtacttgctcacgcgccccgaacatgcgattcgtgatttctatgtgcgcaccgatatccggtttgcagattccggcacgcgtgcggcggccgcgccgcaggccgtgagcgcggacgtgaccgtcgacttcgacttcctcgacggcgtgccggtggagggcatcgacgtcgtgatcggcgacgcggcgggcaatgtggttgcgcagggcgtgacggaagcggttcagtctgaaacgggcacggtgggggagtctgcccaccgaaggcaagcggttgagaacggcagcgcattcccggcgaaggcgcgcgtgaaactcaccgtggaacaacccgtgctgtggaatccggaggtgccgacctgctacacgctgatgattctgagcgacggcgaaagcatcacgcaaccgcttgcgctgcgcgacatcgccgtcgtggcgcccgacggccgccaccagaccgtgctgctcaatcgcaggccgattgtgatccacggcatgaaccggcacgacagcgacccggtgaccggttatacgatctcgccggagcagttccgaaccgatctgctgctcatgaagagccacaacgtgaacggcgtgcgcaccagccactacccgaacgcgccgcattactacgatctgttcgacgagctcgggttcctcgtgatcgacgaggccgacatcgaggcgcatggtgtggccgacgccgtgttgccgaagcccggcgcggaatctgcgaatatggaggaatggcagcgcgcgcagctcatgtggaacggcctcatcgcgaacaatccgcggttcgtgccggccattctcgaccgcattcagcgcctcgtggaacgcgacaagaaccgtggatgcgtgatcttctggtcgatgggcaacgagtccgcctacggcatcgggttcgaaaaagcgcttgagtgggtgaaaacactggattcgcagcggctcacccattacgagagcgcgcggtatgtcgaagaaggcggaacgcttcagcatgactacggcaacatagacgtgcacagccgcatgtacccgagcatcgccgagatcgacgcgtatttcagtgaatccgggccgaacggggacggtgcgaatggggaggacggcaccgcggaaaacgggcaggtgaagccctacatcatgtgcgagtactgccatgccatgggcaacgggccgggcgatctcgaggactacttccagtgcatcgagcggcacgaggggctgctcggcgggtacatatgggaatggtgcgaccacgcgatctacgccggcaggaacgcgcgcgggcggcaggaatacctgtacggcggcgacttcggcgaatggccgaacgacggcaatttctgcgtggacggcatggtttcgccggaccgcacgccgcacagcggcctcgacgagttcaagaacgtgttccggccggcgcgcgtggtgagcgtggatgccgagcgcggcgtggtgaatctgcggaaccattacgacttccgcgagcttggtgaagcggttatcgtgatgtgggaagtgtatgtggacggcgtgatgcagacgtacagcctcgtcgagccgggcacgttcgcgattgagccgcatgcggtgggcgaagtgcgcttaagcggttgggagagcgtgtggccggtcgcgcagcccgggcgagtcaccctcgtgctgcggtacttggcgcgcgaggcgcagtgggggcaggagcagctgttcgaactcggcttcgacgaggtggagttgccgaatccgaccggagataacagttcgcagtgggtgcgtcaccaggtggaagacatgctcgccggcgacgagataggcgagtcggtgacgttggaggaatccgatgcgcgcattgtgatcaacggcgcgaactggcggtacgtgttcgacaagtgcaccggtttgttcagcgagctcgtgtacgcgaaccgcacgattctcgcgacgccgatgaccctcgacatctggcgtgcgcccaccgacaacgaccgcaatgtgcggcatgagtgggagcgctgcgggtacgaccgcgcatatgcgcgcgcgtacgacgtgcagacgcgcaccgtggtctccagcggcattggcgaagcggcgctcggcgtggacggcggcgcgtacggcgaagagacggccgtggaggacgccgaggggccgatggcggtgaacgcggtggaaatcaagtgctcgatgggggcggtcgcgcccacggtgcagccgatcgcccgcatggacaccacgtggacggtgcatgcagacggttccgtagcgcttcacatgaacgtgcgcaaggatccggcgttcccgttcctgccgagatttggcattcacatgcaactgctgaaatccatgagcaacgtcacctattgcggcctcgggccgaacgaaagctatgtggacaagcggcgcgccagctggcacggcgtcttcagcgcttcagtgagccagatgggcgaacgcgagatcaaaccgcaggagaacggcaaccaccacgattgcagctgggcgagagtgcagggtgacggggtggcgttgatgattgtgcagggcgacggctcgcagcccgagagtcccgcggaactgttgcgcgggttcgatttccaggcgttggaatacacggcggccgagatgacgcgcgcacggcacgatttcgagctgcagccgagcgggttcaccgaagtgagtgtggactacatgcagtccggcatcggttcgaacagctgcgggccggagctgctgccgcaataccgcctcgatgcgccggaattcgacttcgccatcacactgcgtccgcagctcgcctgagtcctgtgtgccaagcgttcgttgtgccgagcgcggtggttgcgccagggtgccggtggttgcgccagggtgccggtggttgcgccagggtgccggtggttgcgccagaagctgtaatcgtgagtcgttaatcctctgcgtaaaaagagacgcatgcatgccgccatctgtctctttttccgcagaagattgcgaataagagacgtaaaaagggacgtgtggatatgcctatttgtctctttttacgcaagaagggggaggcgctgaacgcgtgggcagctagtcggcggtctttcgacgcgacttcgcggggagcggcggcagtgaactcggccaggattcgcgagcggcggcattcgcctgcgtgcgcgtgtctcgaatggtgagcgtggcggtgagaccaaggtggtcagtgccatctatgaacacggcgcgcacgttggaggcggtcatgaaatcggtgaacagaatgtggtcgatcacaatgcgcggccatttgagccagctcgggtaggtcgggtgttccccgcgcgcctcgaccagggcggcgtcgtggaagccgctcgcgagcagctcgcggaagctcgggtgcacgatgctcgagttgagatcgcccatgagcacggcaatttcgcgattgttgcacgagtcgtctgcgttccggtcccggtccttgttcgcagatttcgccagcgcgccaagcccgatgatgccggcggaccaatccttgcagctgcgttgcggcgatttcgggtgggcgctcgcgaacgtgatgttgaacgtcgacgtgaccggcagtgtgaccgtggggacgtcggcggcgggaatcggcacgccagtgggcgtctgctcggccggttccacgcgcagccacaggccgttgaagccgccgttgtcggagctgctggggtcgccgaattggtggaatggcagcagatcgtcgagtccggcatcgtgcagctcggtgacgaggtcggggctcatttcctgcagggcgagcacggcgatgtcgttcgtgcgcaccgtgttcacgatttcatgggcgttggcttcgccgtatctgcagttcagggtgaacacgttgaaatggccgtttgcaagattttcaacggcagccgagttggatgaaatggttaagttctccgattccctcttttcggcgagcttgcgggcgatgagttcgccggtgttgggagtcttcaggtcattcatgtaatacgcggttttgcgtaggagtgaagcgatcaagccaacgattgcacacgccataagcggccattcgcgcaggcagccggaccagatggcgacggcggtgatgccgatccacgcgaacggcgagagcgcgatgaggtagggcagcggcgcgtggccatcccagccggcgggcaactcgctcagcgagatccagaccagcagcagtaccagaatcacccacagtgcaatgatcatgcgttctcctcgttgctcgggcatgccgggcccacgccccgcagctgagcatattgtacgcgagatgcctcaaaggcgcgctcagaggggattgcgtccggccatccttccctgctttccgtctcacggagcacctgaacggttacgggatgccttctagcagttacgggatgtctttaacggctacgggatgttttctttctttggagatgtatttgcaatggcgcaaaacttaccaaatcggcgtgttaaccgtactgagacgaacattaataatatgatttcgaacatttcctcgcaggtctatttgggctgtgacatcccgtaaccgttaaagacatcccgtaagagttggtgacatcctgtaaggggtagaggggggtagagaggggtagagggggtcgagggggatggaatatggggatggaatagggggtggagaatggaggagtctcggttgtctcagtcgaagacgaaatcgacgttcacgaggtgcagcttcggctcgagcgcgcgctccatccgcttgcgcgcctcgacgagatcctcgacccgcacgacatcgccggtgccgttgacaatgatgtcgatgtcgaaattcatgcccgtcttgaatacgtggatcgtctgcactttcacgccggccggcagatgcgcggacgcttcgcgggagacgagttcggagacctcctcgtcgtcgtgcgtgccgccgatgagctccacaaacgcatcgcgcagcacggtcaccggttccttgatcgtcagcgcgacgatgatcgtcgtgatgaagaaatctccggtgtaatgcaggaagtcgagcggcgtgccgttgggcagaaaatacagcagcacggcgacgatgccgatgccgagcgagatcatgccgtcgatccacgtgccgttcgcctccgccttgagcatgaggctcgcgttgccgagcgtgcggttgcgtgcgcggtaatacgcgacgagcgcgatgcagacggcgacggcgagaatctggtagatgatcaccgggccgaattcgagacgctcgccctcgccgtgcacgaagtaggcgatggcaatctgcgcgacgtcgaggaacgagaacagcagcaggcagatcgtgaaaatcgatttgcagatcgcatagatcggctcgagcgcgaacatgccgttcgggaagcggtcgctcacgcgcaccgtcttcttcgacaggtatgccgcgacgccgcccgagattaccgagatcaccgtgaacgaggcgtcgaggaacatggacttgagtccggtgaggaagaacacgaagaagcccgcgagcaccatgacgatattgacgacgatgcccaccttgagcgcctgctgttcgatcttcttctgatgcatgcttcctcccgtcgcgcagaccgtgtgcgtattcccggattccagcttatcgaatttgcgcagcggcgtggcaagtgtgtggccaagctccacgatttcccctctgcaagctagaattgtggacattatggcagcatttagttcgttaacagatcgtctctcgaatgcattcaagcatctcaagagcaaaggcaagctttccgacgcggatatcgacggtacaatccgcgaaatccgccgcgcgttgctcgacgccgacgtctcgctcgacgtggtgcgctcgttcaccgcgcgcgtacgcgaccgcgcactgagcaccgaggtttccgaagcgctgaatccggcgcagcaggtggtgaggatcgtcaacgacgagctcaccgacattctcgggcagggagtcgatcgcccgctcaacttcgcgaagaatccgccgacgatcatcatgctcgccggtctgcaaggcgccggcaagaccacgctcgccggcaaactcggctactggctcaaggattccggccacacgccgctgctcgtggcggcagatttgcagcgcccgaacgcggtgacgcagctcgaggtggtgggcgagcgcgccggcgtgcccgtgtatgcgccggagaagggcgtgcagtccgcgggcggcgatgcggtgtcggcacctggcgagaccaccggcgacccggtgaaggtggcgcgcgactcgattgaatacgcgcggcagaaaatgtacgacacggtgatcatcgataccgccggccgtttgggtgttgatgagacgctcatgcagcaggcgcgcgatattcgcgacgccgtgcagccgaacgaagtgctgttcgtgatcgacgcgatgaccggtcaggacgcggtgcgtactgcgcaggccttcgacgagggcgtgaacttcaccggcgtcgtgctgtcgaaactcgacggcgacacccgcggcggcgcggcgctctcggttgcctcggtgaccggcaagccgatcctgttcgcgtcgaacggcgaggggctcaaggacttcgaggtgttccacccggaccgcatggcctcgcgaatcctcgacatgggcgacattctcacgctcatcgagcaggcacagcgcgagttcgacgaggaggagacccgcaaggccgccgcgaagatggcggaaggcgagttcgggctcgacgacttcctcgcccagctgcagcaggtgcgcaagctcggctcgatgaagtcgctgctcggtatgatccccggcatggcacagcatcgcaaggaactggagatgttcgacgagcgcgaggtggaccgtaccgaggcgatcatccgctcgatgacgcccgaggaacgccgcaatccgaagatcatcgacgggtcgcgccgcgcacgcatcgcctacggttccggcgtctcggtctcggccgtgaacgcgttgctgcagcggttcgagcaggcgtcgaagatgatgaagcgcatgaccaaccgcgccggcatgggcggcggcatggcaggcggattcggaggatttggcggtcccggcggctcgaagaaaggcaagaaaggcaagaaaggcaagaagggcggcaagtccggcaacccgatgaagcgcgaggccgaggagaaggcattgcgcgccaagctcgccggcaagtcgaacccgggcggctcggcgttcgcgaagaaaccgcaggccaacgaactgccggccggtttgcaggacatgctcggtggcgctgacgttccgtcgaacctgggcggcggactctccggtctgctcgggtgagctcgggcggttggcgcggctgggcgtggctgggcgccaggttcttcaccaggttttcctctgcgtaattggggacagatagcgggtctatctgtccctttttacgtcccttcttgagttcatcgtggcgcatttgaattgaggtatcgcataaggcaaccattggcggcttcgctggttggggtgaggttgggattgcaatggcgacacgtgtagcttccatatggtggtcgtcgtgagattgacgctgcaagtgtggcatgcggatctgtctgtagtagtcgtcgcgagattgaatttgcaagtgtggcacgtctgcgggtctcttgggttgtctgttttgcattccgaatctcagtaaggttcgttgaggcgcgctcggtggtttgggtgaggctcggcgtgcaaaggtggcgcgtgaatctgtgctgcgatggtcggtgtgaggtcgaatctgcaaacatggcatgttagatgtcgcttactggctgggttgagattcgagttacaaacacgacatgtttgcgaagggccgaacatgccgatctgagaccgcaattgcaaacgcgacacgtgcaatgtcaaaagtaagacgacgtaaataggaatagacagaaagatgtatccgcctcaatctccatgtgaagatgggcgggcagagaagagagaaatttagtataaataagggtgatgttagcgtaaaaagagatagatggaagcgcgcaatgaccctttttactcagggaatggggcatgggagggcatagggaatgggtgcgtggagattggatgtaaatggggacagattggctcgctatctgtccttttttatgcagaaataagatgcatgagatggcatcggtattagcgtaaaaggagacatctataggcttcctgctgtccctttttgcaaagaaggcaaagaagtccgcgcccccggtgggactcgaacccacactgggtgatctgtccctttttacgcaggaaatagaacgctgaatttttataccggggatagagcgctgaattggacgtaaatggggacagttagaaccgctatctgtccccatttacgcaaagaagtccctttcgcaaaggaacttcatgtacgcagaggggctttccagagggagggatgcgcaatcagcgggagggggcgagggtccaggtggaaccggtggggccgtcttcgattgtgatgccggcggcggcgagagcgtcgcgaatctggtctgcctttgcgaaatccttgtttttacgggcttcggcgcgggcggcgagctgcgcgtcgacgagttcgccgagtgttttgagcgcgctggagtcgccgccggcctcgtcgccgccgtcaatccacggactggcaagcgggtcgagaccgagcgtgtcgagcatcgcgcgcacattgacgagcgcggcacgcaatgcggtgcggtccgcgtcgtcggcgttgcccgcgaggcgcgcaagcaatgtgttgccctcgcgaatctgcgtgaagatcgctgcggtggcgcgcgacacattcacgtcgtcgttcatggcggcgacgaaatccacgggcagattgtcggccgagacgccggtgatctcgtcacgcgacggctgctcaccgagcgcgtccgcggcatgcccgatgaagttcatgatgcgctcgtatgcggcctcggcttcggcgagcgtctggtcgctccactcgagcatcgagcggtactgcacggagccgagcgcatagcgcaccacccacgcggaatgctcggcgagcacgaccggcaccgacaggccattgccgagcgacttgctcatcttctcgcccttggcggtcacccatgccgaatgcatccatcggttcgccgtgcggtagccggccgcgcgggtctgcgccatctcgttctcgtgatgtgggaaacgcagatcgagaccgccgccgtgaatgtcgaacatgccatcgagatagcggtagctcatcgccgagcattcgatatgccagcccgggcggcccgtgccgaacggagtcttccagcgggcgtcggcgggatcggtgctcttcgggcgcttccacagcgcgaagtcgcgcgggtcgcgcttgttctcggaaaggtcggccgggtcggcgggattgtatttgtcgtctccggaggcgtcgaccgacgggcccatgcgatcggccacggcggcggcctcgtcaacctcggcggtctgcttctggtgcgtgagctcgccgtagtgcggccaggaggcgacgtcgaaatacacgtcgccggtcagttcgccgtgctcgtcgcggatcacataggcgtggccgttgtcgatgatgcgctcgatcaagtggaccatgtcgatgatatgcccggtcgcgcgcggctcgtacgtgggtgcgagcacgccgagctcgttgtacgcgtgcgtgaactcgcgctcgtaatggtatgcgcgtgcccaccaatcctcgcccgctgcggcggccttgtcgagaatcttgtcgtcgatgtcggtcacattgcgaatgaacgtgaccttgtagccgagccgctcaaaccagcggcgaatgatgtcgaacgcgacggccgcgcgaatatggccgatatgcggggcgctctgcacggtcgcgccacacacgtacatgcccacttcgccgggtttgatcggctcgaaacgcgagaccgcatgcgtcgccgtgtcgtagagcttcaaatcgacggccgcattggcaacgccgtgattgccggcggcgagcgtttcgtcaaattggtctgtagtgtgtgattgcgcgtgtgtcatagtctgagcgtattgctcttcggcgacaagccgcgcccgcacgcatactcacttgccgagttgctcggacagatcgaaccactcggtctccagctcgccctgctgcgtctccagttcggcgatctgcgcgctcagtttgccgagcccctcgtaatcggtggggtcgtgcgcgttcatctgggattccagctcgcctttctgctgctcgatcttctccagtttgcgctcgatcgccgaaacgcggcgcgatgcctgcgcatattccttgccggagagcttcggctggtctgcagactgctcgtcggcagttcgcacgttctcggattgcgcagtgtgcgcagattgcgcagcatccgcggaatccgcctgcgggagcgccttgccgcgcttgagatcgtccaccatatcgagatagtcctgcacgccgcccggcagatgccgcaccttgccgccgatcagcgcgaactgctcgtcggtgacgcgttcgagcaggtagcggtcgtggctcaccacgatgagcgtgcccggccaggtgtcgagcaggtcttccatcacggcgagcatgtcggtgtcgaggtcgttgcccggctcgtccatgatgagcacgttcggttcgtcgagcagaatgagcagtagctgcatgcggcgcttctggccaccggagaggtcgcggatcggcgtcattaactgggctccctcgaatccgagacgttccataagctggccgggcgtcacctccttgccgtcgacgatgtaggtgggcttgtagcggctcagcacctccttcaccttgtagttgccgagcttctccaattcgtcgagccgctgcgagagcaccgcgaacttcaccgtcttgccgatgttcacacggccggcggtgggggcgagcgagccgtcgagaatcttcagcagtgtggatttgccggcgccgttcgccccgacgatgccgaaacggtcgccggggccgatgagccaggtcacgtcgtcgagaatctcgcggccgcttacctcgatatgcgcggcggcactcgtggcgtcggcgccggtgttcgcggcttcgttggcagcgagctcgttctcggtcatgccacgcagcgcgttgtagccggtgacggcctcgcgggccttgagcccatgctcggcggcaatttgcgcggcacgcgagccgaatgcggagatgaggcgcgggtcgtcggcatcgtcgacatccatcgtcaccgagccgaaagcctgcggttcttggaccatcggggtgacgatgtcaatctgcgtgccggcggatgattcggagtccgtgcccatgcgttccatgtcggcgatgtcggggtcgatgtcggccacagcaccctgttcgcggtcgaaaatctgcgtcacatcgaccaggtcgaccacctgcttgccaaggcgcgaagtggccatctgcttgagttcgagcgtgttgcgcatcggcggcacgtcggcgatgagctcgcgcgcggccttcacatggaacttctgcttggtcgagcgggcacgcgcgccacgcgacagccatgccagctccttgcgggccagattgcgccgcttcgtctcgcgcacatcggcttggcggtcgcgttccacgcgctgcagcatgtacgcgctgtagccgccttcgaacggctcgatctgcccgtcatgcacctcccacatcgactcgcacacctcgtcgaggaaccagcggtcgtgcgtgacgatcagcagcgcgccggtccccttcgcccaacggttcttcaggtgttcggcgagccagtggatcgtcacgacgtccaggtggtttgtcggctcgtcgagtgcgagcacatcccagtccttgagcagcaggcgggcgaggtcggcgcggcgacgctggccgccggagagcgtgccgatcctcgcattgagattgaggccgccgagcagcgcctcgacgatctcgcgggactccgtctgcgcggcccattcgtaatcctcgcggccttcgagcgcggcctcgcggatcgtggcgtcatcgtcgagctggtcacgctggtcgagcatgccgaacgtcaggccgttgcgcgtggtgacacggcccgaatccggagcctgcgtgccttcgagcaggtgcagcagcgtggatttgccgtcgccgttgcggccgacgatgcctatgcggtcgccttcgaacacgccttgcgtgacgtcggtgaaaatggtcttcgtggcgaagtcgagcgagacatgttcgagtcccaaatcaaaagttggcatggcaatctttcattgttcgtgacatcccgtaagagtttatgacatcccgtaagaaaacaaatcacgggggagatggagggaatctcaaggaattccaaggaatatcaaggaatatcaaggaattcagagaacatcgcgcattctgatcttccttacgggatgtcgtcaactcttacgggatgtcagagagaaactgtaggtgctgcaacgggcggcgaaaccggagaagacctgttcgccgagcggctggatttgcgggtagctggcggcgaacgcctcgcgcagctgcgatttcgagccgccggaagccttgagttgcttgaccatgctcggttcgtcaagccattcctcgagcagctgcggcgtgacctccaagtggaactgcatgcccagcgcggagccgaagcggaatgcttgcactctcgtgtcggaggagcgggcgaggagctcggcggaatccggcagcgaaatgcagtcgccgtgccattggagcacgttgagttccttgctccacatggagaagaagtcgtgtttggccacgcgtttgatgggcgcgatgccgatctccggcgcgctggccttcttcaccctggcaccgagcgcggcgccgatgagctgatgccccaggcagacgccgagcaccggcttgcctgtgcctatggccgcgcggatgagcttcatctcggccttgagaccggggtagtcgtcgaaatcggcggcgcccatggggcctcccatgaccaccagtccggccacttcgtcgaaatcgggaaggtcgggtttcttctgcttcgatatattgagcgtctgcgtgggaagattgatctcctcaaggtcggacagaatgagtcctggtttctcccactcggcatgttgcagaataagaacttccggtttcgtcatggtttcattgtctcattgcccttaacaattcggctgtcggtgtggggacgacgggtgaatgaatgcggaaaacaggtgtcagcatgcggaaagcatgcatcagaatgcgtagaaggggacagtgagaagcttctcactgtcccctttacacagaatatggaatgcggaacgcagattcagcggccggtgatctcgctgccgaccactttctcgctcagcgcgcgcgggccgcgggtcatcgcgaccgcgccggaacgcacgagctcgatgatgccgtagtggtcgagcagaccgagcagcgcgtcgatcttgccgccggcgccggtcgcctcgatcgtgagcgactcgggattgacatcgacgacgcgcacgcggaacagtctgacgatctcaagcacatcggagcggttcgattggtccgcggcgaccttgatgagcacgagttcgcgctcgacggtggtcgattcgtcgaggtcgacgattttcaacacatgcagcagtttgttgagctgcttgatgatctgctcgagcggcacctcctcgacgtcggcggtcaccgtgatgcgggagatgtcggggcgctcggtgggtgagacgctcagcgagttgatgttgaacgcacggcgggcgaacaggccggcgatgcgtgcgagcacacccgggcggttctcgacgagcaccgacagcgtatgacgctgggaacccggcttggatgctggatatgaagccatttcgaccttcccctttcagtcctgttcctcggtgatgatggcggtagcctcatctgcctgcgcatcggaatccaccggcatggcggcaaggccgtcagcctggtgcaacggtttgatgccgggcaggtaggtgacgttgtcgttcgaatcgccagcggcgaccatgggccacaccatggcatccttccacacacggaaatcgacgagcaccggcctgtcattgatctcgttggcccggcgaatcgcctctaccgcctcgtctttggtgcgcgcgcgcaatgcaacgcagccgtacgcatcggcgagcttgacgaagtccggaacgccctccaagccggtcttctcctcctcatgcagaatcgtggccgagtagtggttgttgtagaacagggtctgccactggcgaaccatgccatacacggagttgttgagcagcgcaatcttcaccggggcgccctcgaggaacgcggcggcgagctcctcacttgtcatttggaacgatccgtcgccgtcgatgagccacaccggcttcttgccgtcgaagtagcgctgggagccgatggatgcgccgatggctgccggaaggccgaagcccatggtgcccaagccgcccgaggagatccactggtgcgggtgcgagaaattgatgaactgcgtcgcccacatctggtgctggcccacgccggacacccagatcgtctccggattcgcggcatgcgacagctcctcgaccacccactgcggagcaagcgtgccgtcggtcggctcctggtaggtgagcgggtatttctcgacccacgagttgataagcccccaccatgtggtcagattcggcttgccgtgaatggcgtgctggcgttcgatgcgcggcatgagcgcgctcagcaccgtcttcacatcgccgacgatcggcacgtcgggagtgcggttcttgccgatctcggccgggtcgatgtcgatgtgaataacgcgtgcgccgggggcgaaggcctcgagtttgccggtcacacggtcgtcgaagcgcgcgccgatcgcgacgagcaggtcggagcgctgcaccgcgccggtcgcggcgatcgtgccatgcataccgagcatgccgagcacggcggggtcatcatccggcacaatgccacgcgccggcaatgtggtgacaatcggggcgccggtcagatcggagagcgccttcacctcggcaccggcgtcggaacgcactgcgccaccgcccacgtagagcaccgggcggaacgcgtgctggaacagtctggcggcatcgtcgagcacgcggccatgcgcctcggtggtcgggttgtagccgggcagaatcatgcgctgcggccagctgtaatacatggtgccgttctgggcggtcttcgtcagatccacgaccaccggtccgggacggccggaacgcgcgatgtagtgtgcctcggagagcacacgcggaatgtcctgcgcgtcggtgaccagataggaatgcttggcgaccgggtaggtggcacccacgatgtcggcctcctggaacgcgtcggtgccaatggcgttgacgcccacctgaccggtgaccacgatcatcgggatcgaatccatgttcgcgtcggcgatggcggtgatcacgttcgtggcgcccgggcctgacgtgacgatgcacacgcccacctcgccggtggccacggcgtaaccctccgccgcatggcctgccgcctgttcgtggcgcatgagcacgaaacggaacttcgtgtgctcgtcaatggcgtcgtacacgggcagaatggcgccgcccggaataccgaacacgactttgacacccaggtcttccagcgagcggaccagcgcctgtgcgccggtcatcttctcgccgtcgacaatggtgcgcttgtgcgtatgctggttggcgttcgctttggccacgccgctgaacgcctgcaggggtgttggtgacacggttccctctttcgtgagatgtcttgtattcaaggcatcggctgcgggtgccattcgcgtcccgcgccgggccttgcgttgatatcctactggatttcaccgtggtgcggctcctgtgaccgcatgctgaatgcatttatggatatgccctgcttcttcctgttacgggctggcattttctgttacgggctaggggcatgcagattttcttcaacaatggcccttggaaaatggcggttttgcaattccgacgaggggaattcttcgcgtgagacctatcccgtaacagaaaatgccagcccgtaacaggaaaattagcccgtaacaggaaggctagcccgtaaggtgttggctgtgcggcgcagggcgtgcggctcaggcgtcggtcagcgggcggcgttcgcgcttgcgctcgggcttcggcgcatgctcgcgctcgtcgagcacatgccacgcctgttcggccgcggccagctgcgccttgcgtttgctgctgccgttgcccacgccgagcacctccttggaatcgccgagcatggcgaatgcggtgaattcgagcgcgtactccggtccgccgacggacatctggtaccgcggttccggcaagcccatctcgtgggccttcactgtgagtgacgtcttccaatcgagcgccggaccttcggtggccacctcggcgagtgtgtcgtcgacgagatgatgcacgacttcgcgcgccttgtccacgccgtactgcacgaaggtcgcgccgatcagcgactccacgatgtcgcacagaatcgagcttttctcggcgccgccctgctcgctctcgccgtgccccaacagaatgtagggacccacgtgcagccggtcgcgcgcgatcgcgctcagcgactcctccgacacggccttcgcgcgaatcttcgccaactggccctcacttttgtcgggatactgcttgaacagtgtctcggtgacgacgaattcgagcaccgcgtcgccgaggaactcaagccgctcgtagttcttcacaccctcgtgctcgtgcgagaacgagcggtgggtgagcgcctcgacgagcagatcggtctccaatgtggtgccgagcgcggtgaacagctcctgcattgccgattcgccgatttcctgcgtgcttacacgaacactcataatgctccagattccctcgatttggcttccttgcacagtgtagtctgtgtgccctacgcgcgccctccgtacagggagaagattcctttgcgtaatcggggacggtttgaccgaataatctgtccctttttacgcagggcgggagatgcggtgggtataagagatgcagcgggtatgagacatgcaaggtgaggggaatctgcgtaaatggggacagtttgggtgggtatttcgtctccgattacgcaagtaaagccgaaacaatctgcgcgcataaaaaaatccccgccacccgtcgatggcagggatttcgtgaagttcaactcacttggtgtgggcggaacggatcgcctcgcggtagacgcggccgcggtaggagccgcagctcgggcaggccacgtgagcgagcgtcggagcgccgcagttcgggcaagtgatggtctgggcagccttggccttccaggtggaacgacgcgtacgcgtattggcgcgcgacatcttgtactttggcagtgccattgtttatcctctgtttcgttcgaacatatgagcttaagcgttcagaatcttaacgcatatgctgtacaaacgcgcgtctcactcgccctgctcgcgttcgagctgctctttgagcgcctccagatcggcgaaacgcaggtcggtcacctcatgcacatgctcgggactctcgttgagatcgagaccgcactgcgggcacagacccttgcaatccggcttgcagagcggattgagcggcaacgcgctcacgaaggtgtcacgcagcagcggctcgatgttcgcgaacgcgccgttgtcgatgagcgggtacgtgtcgcccgactcctcctcgccggcgatgatctccacatcttcgttcttggtcttgccggcatcggcatcctcatacgggaagaacgcggtgacctgctcgctccagtccccgctcagatccctgtcgcagcgcgcgcacaccgcagtgaccggcgccgtgaacgtgccggtgaaaatgagaccatcgataatcgagtcgaactggccgttcacatggatcggttcgccttccttgacgcccacgatcgagtcgccgatgccgccgggtgccgggaaatcacggtcgacctgcatggtctggcccgcgcgcgagccgacctgggccaccggaaccgtccaatctgtgtattcaatacgtgccattcgcctgttccaccttgcttggattgcttgatacgctcagtcaacccgcgccgccgtgtcgctattccgcgtgacgcgaacgggtcagtcctgcggatagtcggattcctcggcgtgcgggagctcctcgcgcgcctttgcctcgcgctcctcgagcacgttcaggccgccttcgacgtcgcgcgtcatcttgccgagctgactgtgcaactcgttcatgatcttgatgcagtactggtcggcgcccgaggtaagacggtcgctcgcggcctgcgccttgtcgatcatcgtcttcgccttctgacgcgcgatctcggtcaccttctcctgggaggcgagatagtccgcgcgctcgttcgcatcgcgaatgatgttcgccgctcgcgcctgcgcggtggagatgatcacgttcgcctgcgaattcgcgttcgcgagtctgccctccgcctcgcgcatcagcgcgctcgcacgctcgagctgcacgggcagcttggttttgagatcctcgagcttgtcgaggaaatcgtcacggtcaatcttcacgctggacggggagaacatggaccccttggcactcgtgatcatctcctcgagcgagtcgatgatgtcgtacaccgtggtgaactcggccttgcgcagcgcatccgggtcgggggcgttgtcgcgcagatccggcagatcgtccatgttgaacgcgggtctgcgggcggaggagtcctgcggtggttgcggggcgtcgttgccgccgtcgtgaatggtctgcgtgctcgaatcgttctgagtcatgctctctcctctcaacgcgggcgcatacccataggtccgcggtcgcgctactaacgcagcgccttctctaataatggcacaacatagtctggaaccatgccggtgatgtcaccgccatgacgtgcgacgtccttcaccacggagctcgagatgtgttccagaacgggattggcaggcaggaacatcgtctccacataggcgaggtgacggttcacgagcgccatgccgagctcggcctcatagtcgccgttctggcgcagccccttcacaatgacgggggagtcgaccttgcggcagtagtcggtgatcaggccgtcggtccatgcgaccacataattcgtcatgcccgagtcggccagcgcgtgtttgatgatgtccacgcgttcggtttcggtgaacagcggcttcttcatggcattcaccgcgaccaccacatgcacttcgtcgaacaggcggcagcaacgcgtgattacatcgatatggccgttcgtcacagggtcgaacgagccggggcatacagcgattgtcatatctctacagcctaatggtggggctatgcaattggctggccgggaaatccgggaaagagatgcggcacggggctatgagatgagacgcagatggggcgaactgggctgggcgtagaatctgtagacaggaatagagaacgaagttgcaggattgtatagccgaacaggaggaatcatgagctttgcatacaatgacgcgctcgacgacaacacgacggcggcaaccgagccgagcagcgacaccggtaccgcggtgctcgaaaggccgaaggcacaggagcggcgggcggacgacggcgacgccgaccggttcgcgcattacgtgtcgcgtgaccgcattgccgagtcgcgcctgacggggcgcccggtggtggcactgtgcggcaaggtgtgggtgccgaagcgcaacccgaaggactacccgatctgcccggagtgcaagcgcatatacgaggagatgacgaagtaatccatcgccgccagctgtctgttacgggctagggttccggcttatggccagggcacacactccgatttccgtggtgtgtgccctggccataagccggaaccctagcccgtaacagtattacgtaacggtatgaattagagcgagatcgaatcgatcctggcgagctcctccggcgtgaagtgcgtgttgttgagcgcggcgatgtcatcgagaatctgctgcggtttcgaagcgccgacgagcacggtggtcacggcagggtcgttgagcagccacgcgagcgacatctcggcgagcgtctgcccgcgggaaagcgcgaggtcattgagttcgcgaatctgggtgagacgcgactcggtgagcgcggacttgttcaggaaccggtcgtcgtgcccgatgcggctatcggcaggaatgccgttgagataccggttcgtaagcagtccctgctcaagcggcgagaacgtgatgagccccttgccgagcttgctcgtcgcctccttgagcccattgcgttcgatcgtgcggtcgaagatgttgtagcggttctggttgatgatgaacggcacatggcgctcggcgagcatctgcgcggcctgttcgagcagcgggccatcgtagttcgaaagccccacatacagcgcgcggccgctcgtcaccgcggtctcgagcgcgccgaccgtctcctccaacggcgtgttcgggtcggggcagtggtggtagaaaatgtccacatagtccaggccgagccgttcgagcgactggtcgaggctggagagcaggtatttgcgactgccgcccacgccgttcggtcccgcccacatgtcgaacccggccttcgtggagataatgagctcgtcgcggtacggtcgcagactctcacgcatgatatgcccgaaattgcgttccgcggcgccgtacatggggccgtagttattggcgaggtcgaaatggaagatgccgtggtcgaacgcagtgaacacgatctgctgcatctgcccatacggcgtcagatcaccgaaattatgccacaggccgagcgcgatgcgcggcaattgcagaccgctcgtgccgacatgcgcgtactgcatgcggtcgtagcggtccggggcgggcgaatagtgcgtgatgaaatctggcatcggaacctctttgttttctgtgcttgcgtgtgatatgccgactccagcataccgcgaacgtgccgcgaattgcggatcagagcacctcgagcttcgtcgggatcaccggctcgcctcgcatgagcgactgcgcggtgatcggcagcttggcgagcgccttggcatggtaatcctgcgccgccatgagcccgtcgtgaccctggaactgcgggtcaaccgtgccattgacgacgaagtcggtgagcagatcttcccagccctcgcccggcacgaagttctcgagcgcgctctccgagccggagatgacgtgttcgcagtcggcgagcgagtattcgtatgaacggaaggcgagcttggctcccggtgccgtcgccttgtccacagacttcttcgccaccggttccatatgaccggcgttgttcgcgcgttcggtgagtttgtagaccatggcgcaggtgggcgcccccgaaccggtgaccagctgcgtgccgacgccgtaggagtcgaccggcgcggtctgcagcgaggcgatcgcatactcgtcgaggtcgttcgtcaccgtgatcttcgtattcgtggcgccgagcgcgtcgagctggttgcgcacacgctgggcgagcgcggcgagatcgccggagtcgatgcgcacgccgcccagattcgggccggccacctcgacggcagtcttcacggcctcctcgatgttgtaggtgtcgacgagcagcgtcgtgttcgtgccgagcgcggcgatctgcgattcgaaggcctggcgctcgctgtcatgcacgagtgtgaagcagtgcgcggccgtgccgatcgccggcaggtcgtacagtttggcggcgagcagattcgcggtgcccttgaatccacccacgatcgacgcgcgcgcggcggcgacggcggcccactcgttcgtgcggcgaccgcccatatccatgcacgggcggttcttcgcggccgtgaccatgcgcgaggcggccgcggcgacggcggaatcgtagttgaggatcgacaggatgagcgtctcgagcagcgtgcactcgccgaaggaaccgcgcacctgcagaatcggcgaattcgggaagtacacctcgccctcgcggtagccgcggatcgaacccgtgaaatggtagttctcgagccacttgacggtgccccggctcacaatgtggcggtcagagaggaacttcaggtcggcgtcatcgagatggaagtcctcgagcgcgtcgagcagacgtccaatgccggcgaccacaccgtagcgacgtccctcgggcagatgccgcgtgaacacctcaaacacgcaggggcggttcgccgtgccgtcctgcaatgtggcgtcaagcattgtgtactcgtacatgtcggtcatgagcgacgggtcgtaaaccaccatggtgtctcctgtgttagcggtgcgcttctcttgcgtgatctcttcgcgattggccggggcggccgtggattcgccgcgcgcggatgtcgttgttccccagcctagtcgaatgagcgcgcaaatatgcgcggatgtcattattcggagtcttactcgtgcggggatgaggtcctttctgctctctctgcctcttgttgcgtaaaaagggacaaatcggaggcctgtgtgtctctttttacgcaaaagggcagtggcgtgtgtggcgtgcagaggacgctcggcagatgggccggtaggatgggaacatgcgatatcttgcaggaatctggagactggccattgctgcgctgtgcttcatcggcacatcgccggcatggcatgccgtgagcctttgggcgttcctcatgtaccagatcggcttcatcgccggcatcgtcatgctgtggagtggctgtgcgagcattctgcgcggtgtgcagccgccggcattgctgcgcggcttcgtgctcacctacgcgttctcgctggccgccgtgcatttcttcgtcacgccggctgcggagttcggggtgccggcgcagcaggtgatcccgctcagcgcacaggtgctcgcgttgattgtggtgggcatgctcgccgtcgacttcttcgcattcgaaccgcaccgtgcgttcaagccggtgtatccgctcgtctggcttgtgtacctgccgctctatgcagcgttcgcgattgcgcgcgcctactggttcccgcattccggccccacggcgaacgcctacccctacgactatctcatcatcacgcaattcacctggggcggcgcgggcgtggcctgcctcaagatcgtcgccatctatctcgccgtcggcgtggtgctgtgcctgttcgaccgtgcgcttcctgcgaaatcggcggcagagtaggcatccgaacgattgcagatgggcagattctcgcggcccgcttctcgctaccggctatcccacccccttacgggctagggttggagtggcttgcaggagtggggtgcgctggcgccaggtggcggcagatgacggttgaacacattcgttcgcattcggccgatgttgcctctcggcctatgatgtgagagaacgacgagaggattaccatgactgttacccgagcagacggccgtgcatacgatgagctgcgacccgtgcgcatcacccgcgcattcaccgacgtgccggaaggatccgtgctcattgaatgcggcaacacgcgcgtgatgtgcaccgccacgttcaccgacaccgtgccgcgctggcgcaaggactccgggctcggttgggtcactgcggagtattcgatgctgccgcgcgccaccgcacagcgcaccgaccgtgaatcggttcgcggcaaggtgggcggccgcacccatgagatctccagactcatcggccgatgcctgcgcggcgtgattgacatgaaggcgctcggcgagaacacgatccagatggattgcgacgtgctccaggccgacggcggcacgcgcaccgcgtcgatcaccggagcgcacgtggccctcgtggacgccctcaactgggcgaagcagaacggcaagatcaaaagcgtgaagaacgtgctgctcgacagcgtctccgccgtgtcggtgggcgtgatcgacggcgaaccgatgctcgacctgccgtacgtcgaagacagccgcgcaatgaccgacatgaacgtcgcaatgaccggatccggcaaattcgttgagattcagggcaccgccgaacatcgcccattcagccgcaacgagctcggcgtgctgctcgacctcgccaccaagggcaatagggaactccaagccgcacagcaggccgcgctcgacgccgacctgcgctagcacattcgaataagggaatggtgggcatatgaacatcgtcgtcgccacgcacaacgaaggcaaactggtggagattcgcgacattctggccgaggaattcggcgatggcgcgcacgacattgagctcgtctccgcaggctcgctcgggctgccggacccggtggagaccggcatcactttcgaggcgaacgcgctgctcaaggcgcgctttgtggccaggctgaccggtctgccggcgattgccgacgactccggactcatcgtggacgtcatgggcaacgcccccggcattctttccgcacgctgggccggcgagcatggcaacgacgcggcgaacatagacctattgctcgcccagatcgaagacattcccgacgacgaccgcaccgctcgcttccgctgtgccgccgctctcgtggtgccgattgcagccgaggaggacgtcgcggacttcgaggcggacccgtccgatggcatggacgatggcgacgggcttgtcgacgcccgtgaaaccgtggtgctcggcgagatgcccggcacgattgtgcgccacccgcacggcagcaacggattcggctacgacccgatcttcatgcccgacgagcagcctgccggagccgaggaaagcggcgaactgctcacctccgccgagatgacccccgagcagaagaacgcgatctcacatcgcggcaaggcgctgcgtgcgctcatgccggcgatccgcgaactcgtggagaccggtgagtgagccggaagcaatctggaaacccgagaccgaatacaggacatatgcgcaagttttcttttgaagtgttgaacgagcaggaattccgtgcattcgcggaggcgtcgccgcagtcgaatttccagcagaccgtggagatggcgaatctgcgccgcatgcacggcatggacgtcgacttcgtgggcatgcgcgaggacggcgagatcaaggcgggggccgtgttcgccacgcatcatgcgccgatggcgacgttctgcagcgtgatcagcggcccgctgtgcgactacgatgacgacgagctcgtcgccgaattcctgcgcgcgctcgcccgattcgcgaagaagaagggcgctgtgcacctcgacatcgcgccgaaccagcgctaccgcgtgcgcgacgaccacggcgaggcgctgcccgagagcgagggcggcgcgccggacaagcgcatgatccgcaacatcgaacaggcaggatacgagcacggcggattcgtgcgcggctacacgtcgaccgtgcgctggcggttcgccaaggacatgaccgggatcggcgacgaaagcgagctgctcaagtcgtattcgaaacgcacgcagtggagcatcaaacgcgccaggtcgatgggtgtgcatgtgcgcgagatcggcgtcgacgagctcgacaccttcgcgcggatagaacagcagaccgcggaacgccggcatttcgaattccgcggaccgcagtatttcaaacagttcgcgcaatgcttcggcgaacgggcccgattcgtgctggccgagatcgacaccgcagaataccagcggtcgatgcagcgcaaggccgacgatctgcgcgcgctcgtcgacgggctcgaagcgaagatcgcacagcgcgagacgaccaagctacggcgcaggctcaacgaggaatcgagcaatctggcggccgcgaacaagcggttggcggaggcgaacgagctcgtggagaagggcgacctcattccggccgccgcctcgatgttcgtgctcggcccgcgcgaagtggtctacctgttctcgggcagcgtggaggaatacaagccgttctatgcatcggcactcattcagcacgaggcgatgctgcggtactgcgtgcagggtgtggaaccgttcgggcatgtgaatctgtacgacttctacggcatcgacggcattttcgacgacccggatgacgagggacgcggcgtgctcgaattcaagcagggattcaacggctacgtggtggagatgccgggcgacttcatgaaggtgctgcggccggtcacctaccgtgcccagcgcctcgcgcacaagctgctcggcaggtagccgaggcgtcagcccgcaccggtaccgaatcagatgatgccggcggcgatcatcgcgtgggcgccggtcatcatgccaagactgatcaccgcgctcaccgacagcgtgaagccggcgagacgggcgttgccgagcacctcgtcggtgaacagcgtggagaagacggcaaccggggcgaggcagcacatcatcgtcgcctcgcgaatgccggcgtcgaacggcagcaggaaccaagccacggcggcgaacgccaatccgaagggaagacgccaggcgagcaccttgagcacggcgaaggtgtcggaacggttcgcgggcagatccatcatcatgcccaccatgagcatggccacgcaggcgttcgcattcgacagcggccggaagagatccgcgaaccaggcgggcagcgacagtccgcagaccatgagcacgatcatgatcacatacgtgtcgaacggaatggaacccacaaaacccttgagcaccgtgtgcagcagcgaacgccgggcgagacgcttggcatcgcggtccgtggggcgcgtgtagggaagtgtgggagcgtcgccggcgccttgctcggtgaggggacggccgggttgaatgtgcaggagcgtctgcgtcatcacattcgtgccggcggccaccatgatgcaattgccaatgtcgaacatggcggcgggaacgatcgcctgttcgccaagaaacgcctgcaccaccgggaagcagaagcagcctatgttgagaccggtcgcattgagcatgaggaacgcgcgctgcgtgaccggcgagtgacgggtggccgagaagatcacgagcaccggcacgagcgccacgacgaaaccgaaggccgaaagccataacagcgacggatcatgcggattcgtggcgaacgagtagacgatggcaccgggcagcacgagatcgaagagcatcacctgaatgatgcggtaatcgcgctggccgaacaaccggcagcgtttgaacaggtagccggcgatgatgatagccaagagggcgatcggttgtaggagcgtcacggagtacagcctacgccgggatatggctcgggtgagggggaacgtccacgggacaatctggaaacatggggagaacgtccacgggacaatctggaaacatggggagaacgtggagaagggtgcgcgagatgggactcgaacccacacgaccgaagtcacaggaacctaaatcctgcgcggctaccaattacgccactcgcgcgcgttggatatgcaaaaccctaggcggcgaacgcgtttgcgccgacgtctagggcaatggagccacttgacagaatcgaactgtcgacctgctcattacgagtgagccgctctaccgactgagctaaagtggcacatgcttggtgcacaagaaatacagtgtagccgaattgctggatttgacgaatcggcgtgtcgcgtttgggcagcatgagggagccgaatgcgcgcgagcggatagaatgagggcatgagtaacggattcgacgatttctacgccatcattcccgcgggcggcaccgggacgcgcctgtggccgctgagccgcgaggccaaaccgaagttcctgttcgacctgctcgggtcggggcgcacgctgattcagtccaccttcgaccgcctcgccgccatcgccggcatggaccatgtgtgcatcagcaccggcgaacggcatgtggacgccgtggaggagcagatgcccgaggtggcgccggaacacatcttcgccgaaccggcaccgcgtgattccacggccgccattgcgctcgccaccgccgtgctcgcccgcaggcacggcaacgacattgtggtcggatcgttcgccgccgaccatgtgatccgcggcaaggtggcgttcgtcgacgccgtgcggcaggccgtcgccaccgcccgcgccggctatgtgaccaccatcggcatagcagcctcgcgcccgagcaccgcattcggctacatccacgaaggcgagtcgctcgcggcccgcgttcccgacgccccggacgccgtgctcgtggaacgcttcgtggagaagccgaacgccgccaccgcgcaggcctacctgaacaccggcgaataccgctggaacgccggcatgttcgtgatgcgcgccgatgtgctgctcgaccacctgcaccgggtcaagccacagctcgcacgcgcgatcgatgcgatagcagacgccgtgatcgaagacgatcgcgatctcgcccgcgcgcaggccgaggcacatgagcgcggcgagaacgtgcgcgagaccgtgaatcccgacgacttccacgcccaccgcgacgaggccatgcgcaagtactggcagggaatcgagaagatcgcgttcgactacgcagtggccgagccgctatcggtggagggcggcgtcgcgatgatcccgggcgacttcggctgggatgacattggtgatttcaactcggtggcggcactgttgccgagcgtggacgagcggaatctgaaaatactgggcaacaccgagcaggtggtcacactcgactccgccggcgacatcgtggtgccgaacagcgaacgaaccgttgcgttgcttggcgtgaacgacatggtcgtggtggatacgccggatgcattgctcatcacgccacgtgcgcggagccaggaagtcaagtcaatggtgaaaacgctcgcggagtcggggtgcgacgaactactgtgagagccaataactgaaacgagacacaggcttgcggatgacgccatatgcgcgggcgaatgtttgaaaacgatttcataggtttgcctgcgtgaaagcgaacagcgaaaatgttcgctttcgtcccgatgttcgcactgtttacgattcgtgtgcggtcgtggggcaaaactgtcgtattttgtgagtatggtgaagcttgataagcaaatgcaaacgcatgccttgctagtctgcaatgcagcacgggcaacggcgccgcagtgcttgtctgatgatgaaaggatcacgaatggcaatcaatcctcctgtcgacgccacgggcaccgcggcgtggaagaagctgcagcagcactatgacgagctgcaggcacagggcatcgatctcaagcagtggttcgaggacgatcccacgcgcgtggactcgctgtctttcgacgtgggcacgctgcgcttcgacttctcgaagaacctgatcaagcctgagaccctcgcactgttcgcagagctcgccgatgaggtcaacctcaagcaacgcaccaaggacatgtactccggcgtgcacatcaacaacaccgaggaccgcgccgtgctgcacaccgcactgcgccgcgacgccagcgacgaaggcaagctgatcgtggatggtcaggacgtggtcaaggacgtgcgcgagaccctcgaccgcatgtacgccttcgccgacaaggtccgttccggcgaatggaagggcgtgaccggcaaggagatcgagaccgtggtcaacatcggcatcggcggctccgacctgggccccgtcatggtgtacgaggcgctcaagccgtacgccgacgccggcatcaaggcccgctacatctcgaacatcgacccgaacgacctcgccgagaagacccgcgacctcgacccagagaccacgctgttcgtggtcgtgtcgaagaccttcggcacgctcgagacgctcaccaacgcccgtcaggcccgcgcatggctgctcgagcagctgcaggcctccggcgccatcgacggcaccgccgagcagaaggccgaggctgttgagaagcacttcgtcgccgtttcgaccaacctcgagcgcgtcaaggacttcggcatcgacccggcgaacgcattcggcttctgggattgggtcggcggccgttactccgtcgattccgccgttggcctcacgctcgccatcgtgttcggaccggcccgcttcgaggagttcctcgcaggcttccgccaggtcgaccagtacttcgccgagacgccgttcgagaagaacgccgtggtgatcatgggcatgatcaacgtgtggtaccgcaacttcttcaaggtcgcctcgcacgccgtgctgccgtacgaccagtacctgcaccgcttcccggcctacctgcagcagctcacgatggaatcgaacggcaagtccgtgcgctgggacggcactccggtgaccaccgagaccggcgagatcttctggggtgagcccggcaccaacggccagcacgcgttctaccagctcatccatcagggcacgcagctgatcccggccgacttcatcgcgttcgcgaacacgccgaacccgctcaaggatggcgaccaggacatgcacgaactgctgctgggcaactacttcgcccagaccaaggcgctcgcgttcggcaagaccgccgacgaggtgcgcgccgagggcactccggaagacattgttccggcccgcgtgttctccggcaaccgcccgaccacgtcgatcttcggcgtgcgtctcgatgccttcacgctcggcgagctcatctcgctgtacgagatggtcacgttcgtcgagggcaccgtgtggggcatcgactcctatgaccagtggggcgttgagctcggcaagcagctcgccaagcagatcacgcctgcgatctcgcagaacgacgaggcgctcgcagctcaggacgcctcgacccgcagcctgatcaacttctaccgcaaggtgcgcgagttctgatccgcacacgctggctgtaattcgcggtggggcggcgattcacgaatgtgggtcgccgcccttccctgttgtgatgcaaggtcggtccgctcggcttggttcgtcggaggccgtgggtaatccagtgcgctttgtataatgtgaagtcgctgtgccggcacgcggatcgccgcatgaatccgcctgcccacgagtccagccgaacctgactttcggcggatcggcacgcgcgtcgcagacaaatctgcggcgatattccagacatccgcgagcatgcgaatgtcgcgaccatacgctggcatgcggcagggtagaggaacaccatggttaacgctattgaggcatttgacgccaagcacatgaagccggccgacgagatcccggcattccgtccgggtgacaccgtcgacgtgaacgtgaagattcaggaaggcaacaactcccgtatccagaccttcaccggcgtggtcatcggccgtcagggcgccggcgtgcgcgagaccttcatcgtgcgcaagatcagcttcggcaccggtgtggagcgccgcttcccgctgcactccccgtccatcgactcgatcaaggtcgttcgtcgtggccgcgttcgccgcgccaagctgtactacctgcgcaatctgcgtggcaaggcagctcgcatcgtcgagcgccgcgacaactccgccaagtgagtttcgccataacggtcttgtgaaggccgggttccgtgttcgggcccggcttttgcttttgcgggcggatatgcggcgatctgcggcagagagcagtatgcgcgccggcgatttgtcggccatggaacatttgttgtgaatggtgaacgccacagtgggtctccgccgaaaatgatacattggagtgcggtaatcatttcgacaggaggggtcatggattcttcgaacgagcccatgccgcagagtccggcgccaatggagacgcacggcaatcgcgatgcgggggcggggaatctggactccgccgggacggagcagcagctcgcctcgacaagggggacggcaatacgggatttcttcctgtggtgcgcgattcccgtggccattgtggtgctgctgcgcatcttcgtattcggcatgtacgtgattccgtcacgctccatggagaacacgatcatgccaggcgaccgtgtgatcaccaccaagctctccccgcggccggtcgcgctcaaacgcggcgacattgtggtgttcaaagacccttccaactggctcgcgagcgaggagaccacctatcacagcgactacttgatcaaacgactgatcggcatgcccggcgacacggtggagtgcgagggggcgggccagccggtgaaaatcaacggcgtggcgattgacgaatccgcgtatgtcaagcccggggaccagcccagcaccttcccgttcaaggtcaccgtgagcgaggggcacgtgttcgtgatgggagacaatcgcagcaattccgcggattcgcgcttccatttgaacgatgcgcaacatggtcaggttcccatccgcgacatcgccggcgtcgcattcgcgcggtactggccgctcaaccgcatctcgtggctgagcaattacagcgacgtgttcgcgaacgtgcccgacgcgggctgatctgtgctggatgcgcgggttttcggagtcgagaaaggggcggtatggcgccgtcgtttgcattggaacggcagattgccgccgacgggttcgatgtaatcgtcggattcgacgaagtgggacgtggttcgctggcaggtccggtgatggtgggcgcggccgcgttccttgcgcgaaatctcgacgaagcacagactgccatgccgcagtatctcgcagattccaagacgctcaccgagcataggcgcgagagtctgtacgagccattgcaggcgtgggtggacggttttgcaatcggttcggcgagcaatgcggagatcgacgcatggggcatctcgcatgcgctcggcatcgccgcactgcgcgcactcgatggtgtggaacgcgccctcggcatgggtagcccgggtgacagcgagattcgcggattcgacgagcgctgcaaatactcgggaacatgggcgtatacgaaacacagtccacagcagcatgcggatgggctgcacgtcggcgcgatactcgacgggccgaacgactacatatccaaggcattgggcactttcgaagcccccgcggtgcccatgccggcacaggtgcgcacgcttgtcaaggcggatgcgcagtgtgccagcgtcgcagcggcggcggtgctggcgaaagtgacccgagaccgtctgatggaacagttggcgcgcgatcatgccgaatacgcgcgctatgggtgggagcgcaataaggggtacggctcgaaggcgcaccgcgaggcgatcgcgcaatgcgggccgagcgatctgcaccgcgtgagctggcatctcgcgtgatatgccggtgggcatcatccttaaggctgagagcgggcgtggtgtgccggggaattcatcccgttgcatgatggggcgtgcgggcgcgacaccgtagcttggaagcatgaacgcaatgcagaacaacaatcccggcgcgccgatgccacaggcgccgcagaacgcgccgcatcccttgccgcaaacccccgcagatgccatgccccacaacgggtatgctccacagcccccaatgactgcggcacccatgccgtaccctgacggagcgccgatgggaggccaatcactcgcgctgcagggaatcgacctggtgatggattacaacacaagcgcttccggcaacccggcggcgacacaacccgcggcatggcagatgggtcagccactcgcgctgaaccacgcgaacttccagcttggcgaaggcgaacgcgtggcgatcatgggaccgtcgggttcgggcaaatcgacgctgctgcatgtgctcgccggcatcatgaagccgacggccggccaagtgctgttccgcggtgccaacatcgaccgcattccggacgccgaacgcacccgcatgcgcaggcaggcgttcggattcgtcttccaatccgggcaactgctgccggagctgccggcgatcgaaaacgtggcattgccgctcatgctcggcggcatggcgtactcgcaggcgaccgatcaggccgccatgtggctggaacgcatgggattgcgcaatctgatgcgcaatcgacccggccagatgagtggcggccagatgcaacgcgtcgccattgcgcgcgcactatgtgtgaatccggccatcatcttcgccgacgagccgaccggcgcgctcgaccagaacaccgggcacgaggtgatgaatctgctcatgcaggcggcggccgcgaacaacgccgcagtggtgctcgtcacccacgacccgaacatcgccgcatactgcgaccgcaccgtgagcatgcgcgacggcatgatcctcgacgcggccaaccggcgcgcaggcatgcagcgccaaccgcagaacgacgccccggcacaggcagtgcagatgggcgcccaaccacaaggagcgttgcaatgagcaccttcgcactgtggagactcttccaccggcacatgttccaccatgacgatgaaccggatgcgccgcgcgaccacacaggcctgctcgccgtcatcgccttcgccgcggcgaccgcgatcttcctcaccgtgctcggcggtctgcacggcttcatctggcgtgcgtcaccagaccatacggtcggctgcttcttcaatgattccgcctgctccacgcacgccaacgtgagcgtcaacggtgagttctacgtggtgctcgccatgttcgcctgcgtgctgctcgtggtgcccttcaccaccctcgcgggttctgcggcgcgccttgccgccacacgtcgcgacgaacgactcgcggtgctgcgactggctggcgccacgacgtcgcaggtggtgcggctgatcgccctcgaagcggtcggacaggccgtgatcggctccgtgctgggcattgccgggtacttcgccgtgatgccgctcatcatgatgctgcacttcgagaaccacaccttcgacttcgaacagctgtgggtggggccgtgggcgctcatcggcaccgtcgtcggcgttgccgcactggccttggtctccgcgctgctcacgttgcgcaaggtggccatcacgccattgggggtcaccgcccgccaaggcgccgcaatgcccggcaaatggcgcgtggcgctgttcgtcgtcgccctcgtgttcggtttcgccatgctcaataacatgaacctcgtggccggcgccggtgtggcggtggcgtatggtgtcgtgttcgcgatcatcggcggctgcttcatgctgctcaacgtgatcggttcgtgggtgatcgccgccgtggcgaagtcgcgtgcgcaccggccgaaatccgccgccacgatgattgcgatgcgccgtattctcgacaacccgaagcgtgcatggcgcaatgtctcgggcatcgcgctcgccgtgttcatcgcgggcatcaccgccgtatgcggcgcactgggcacggcatcgggcgacgccgacgcggagacgctgatgatgatgcacgacatctcgcttggcggcacgctcacgctggtgttcgccgccgtgctggccgcggtgagctcgggcatcatgcagtcggccagtgtgttcgaccaggccgacgaataccacatgctcatgctcgaaggcaccgatgcgctcacactgcgcaaggcgcggttctcggaagtgctcacgccgctcaacacggtgatcgtcatctccgcaggctgctcgttgctgctcatgctgccgctggtgggctcgatgctcagcaacccggccgtgctgctgcgttgcctgttcggcattgtgctgtgctatgcgctggtgaccgtcggcgcggtgagcgcgaaccacaccgccacgcgcctcgattcgatctcgcgccgccgcgacgactagtggtgcgcatcgcctcataattcttaatccttacgggatgtcatcaacgcttacgggatgtcgcgattgagtatcctcacattgatatcgttggaacatagccgtttgttttgtgatctacttcgaagaatatgaaaacctgacatcccgtaagcgttgatgacatcccgtaaggagcaggcgtcagctgaggagcgcggcgatgatcgcgatgacgatggggctcgtcatcgtggagatgagtatgccgtcgcgcgcgaaggtcatgccgacattgtagcgggccgcgtagttgtacacgttctggccggtgggcagtgcggcgagcacgacacagccgtacagcgtgggcccgcggaagcccatggcgaaggcgatgccgaatgcgatgagcggcatcacgatgttcttgagcgccgccaccgtccagatcgccggcagattcgacttgttctgcatcggcttcgtgccgtgcagcgacatgccgaatgccatgaggatcatcggcaccgcggaatctccaatcatgtcgatcgggtcgaacaggaagttcggcacaatgaaatggcccaccttcgacgagacgaccgagacgatgatgccgagcacggtgccgatgagcaatggctggtgcaacggctgcttgagcacctgcttcaccgagaacttgcccttggtggtcacgtcgagcacggtgagtccgaccggcgtgaacagcgcctgctgcatgacgagaatgggcgcgacgagcgccgggttgccgagaatgtacgtggcgatgggcaggccgatgttgttcgaattcaaatacagcgagttaagcacgccgatcgtggcatccggtgccttgaggtggaagaacaatctgttgagcacgaggaagacgagtccgacgccgaccgccgagcagaacgcgacgatgatcgtggaatcgaacagatgtgtgatgttctcctgcgccagaatggcgaacatgaggcacgggctcgcaatgaagaagctcaggcgattgaacacatactgtgcctgggcgccgccgatctgcagacgcgcggccgcatagccggccgcgatcacgatgccgatgacgcagaatccctccattgcgctgatgaggccgcccatgcttctcccttgctccgcgttcctgctctgccgagtgcaagtatatgcacgcacatgcatttcatgcgggcagatttcatttgcatgcaggcgcgcggaatctggctggcgcatcgcagatgcatttggaatgcatgcgcccgcatgcgcgcggcactggtagagtgttggcgaatggaccgcgcgagtgcgcggcaggcgtttggagggactatgcaagacgtgatcgatcgcgcgggggagccgctcaagctgacggtggacgccggtgtgggcgagcaggccgcgctcaccgacctgtgcatgcaggtgatgcgcgtgtactcggtgagcgacgacgagacgcatctgaccgacatgaccgaggcgttccttcgcacgctgccgcatctggacgtgcagcggcatggcgacacgctcgtcgcgcgcacgaatctcggccgtgacaggcgcgtggtgctcgccggccatctcgatgtggtgccggtgatcgacaacttcccgccgaaactgctcgaacccggagacccgctcattctgccgggcgtcgcggaggcgcacccgggcgaacgcgtggtgtggggacgtggcgccaccgacatgaaatcgtcggacgccgtgctgctttaccttgccgcgacgctgacgaacccgaaatacgatctgacttacgtgttctacgaccacgaggaggtggccgccgagaagaacggcctgcgcaaggtcgccgaagcgcacccggactggatcgccggcgatttcgcgatcataggcgagcccacctcatgcggcattgaaggcggctgcaacggcacgatccgcttcgacgtggtcacgcacggcatagccgcacattccgcacgcgcgtggatgggccacaacgccatccacgacgccgccgagattctgcgccgtctgaacgagcatacggacgccactgtgagcgtggacggtctcgtctaccgcgaagggctcaacgcgacgctgatcagcggcggcaagggcaccaatgtgatccccgatgaatgccgcgtgcacgtcaactaccgtttcgctcccgacaaatcgctcgccgaggcgaaggcgctgatgatgggcgcagactgcggtgccgaactcggcaacggcgagcaccaggcgacgggcggtgtgttcgagggcttcggcattgagatgaaagacgaatcgccgtcggcacgacccggcatggattccgaactcacgcgctcgctggcggctctggcgaaggcacgcaccggcaaggaccccgaggcgaagctcggctggaccgacgtcgcccgattctcgcagctcggtgttccggccgtcaacttcggcgccggttcgccactgctcgcgcacaagcacgacgagcaggtggcggaaggcgaactgacgctcatggccggcattctgcgcgactggctgagctgagcgcagcagcatgagaacacggcgtctgtctttccttctcgctctcttgctcttccctgcgtaatttgggacatttggaggcctctatttgtccccttttacgcaagaagacgtaatttgggacatctagtggctgctatctgtctctttttacgcagaggaaggcgtggaggagggggagggagaagagtgtagtgtggggccgcgaggggagagtgaatgacgtccgcatggtggcggaatcttctcgcattgccgtacggatgtgaacagattgtttaatctgcataccttgtggcatactgggcagagagcggtgctgcaacgccgctccgcaatcgatggcgtcgatcccgtcgcggttgagccgtactgcatgcgtatgcatttcgacgtgcacgcgcgcacacgcttaggttccccgcacgctggtgtccgccctcgaccatttgacttttggatgcttccatgggcgcgaagcgcgactgccgtgagagggcggggtgacaccgtgcgaagccatgattcgcgacgccgttgcagcgcgccgcacgaggaacatatgcccgatttgaccgagaacggcttgggttcgcccgagttcgacaataccgataccaccaacaccaccaacgattccacccccacacgccgccgtcgcggacgccgtgtggtgagaggcgccggcgaggcgggcgcccagatgcagctcgaagtgcacgaccgcgtgccgctgttccaggaaccaagcgccgcaatcgaagccggcaagccgaccaaggcgcttcctgcgggcagccacgaggaggaatccgcggaatccggagactccaacgagcctacggcaacgcgccgccgctcgcgccgtgccagcacctccaccaggtcgcgcagcacgcgcaccacgaatgacgaggcagaggagcccacgacgacgcgttcgcgccggggccggggcgcggcacagaacgatgatgaggagccgaccgttcatacgcgccgccgctcgcgtgcgcaggcagacgaagccgaggagccgcgcagcacccattcgcgtcgaagccgccgcacggtgtccgacgaatctgagcagaccaatgacgacagctatgagagccgcacccagcacgtgcttgatgcgttagatgagtctttcgacgacgatgccgagacccacgagaccggccgcggccgttcacgctcgcgttcccgttccacctcccgttcccgcacaagccgtcgtgaggtgctcgaagacgcggatcagcatgaatctgcagatgtggagaacgacgaggaggaaagcagcgcgcgcggcaatcgccgtgccggccgcccgatgacctccctgctgttccaggagccggtgctgccggcacgttcgcgttccacccacgacgaggagaatgacgaaggctccgacgacgagccgctgcacgatctcgatctcaacgaaggcagcacccgctcccgcaagcgttcacgcaatcgccgactgaacgcgcaggagcgccgcgcggccgccgaagtcgagcaaatcgaggaagacctcgtgctcgacgacatcgtctatgcgcctatcgacgacgaaaccggaaagtcgggcgacgaatccgacagcgaggagagcggcatccatacgcgtcgccgtcgccgccgtaagtcgcaggagaacgcgaatgcggaacgcgaggaatccgagaacgaggagggcacccgcacccgtcgccgttcgcgcgccgaggacgaggaggagaatgacgagagcacggtgacgcgtcgccgtcgccgtcgccgcaactcgaagggcggtgaggaagaggaacagccacgccgttcacgcaagcagcagtacatcgatgagatcaccgatgtcgaaggctcgacgcgtctcgaggcgaagaagcagcgccgtcgcgacaaccgccgtgaacgcagccgccagaaccagctgctcgaacaggacttcctcgcgcgccgcgagaacgtggaccggctcatggtcgtgcgtgaacgtggacgccatacgcagatctcggtgatcgaagacaacgtgctcgtcgagcattacgtctccgacatccaagaggtcgccaccgtgggcaacatctaccttggccgtgtgcagaatgtgctgccgagcatggaggccgcattcgtggacatcggtcaggcccgcaacggcgtgctgtatgccggcgaggtgaactgggacgccacgcgtttggagggtcagccgcgcaggatcgaactcgcattcaagtcgggcgatcccgtgctcgtgcaggtgacgaaagacccgatcgggcacaagggcgcacgactgacgagccaggtgacgctcgccgggcgcttccttgtgctcgtgccatccggcggcatgaccggcgtgagccgcaagctcagcgaccgcgaacgcaaccgcctgaagtcgatcgtctcgaagatcgcaccgaaggacatgggcgtgatcattcgcaccgcggccgagggagcgtccgaagaggcgattgcgaaggatctcgaggggctgaccaaccagtgggccgagattcagcgcaagcgcgaggagttcctgcacggcaagcgtccgaagctgctgcagggcgagcctgacgtggcgattcgcgtggtgcgcgacattttcaacgacgacttcaacaagatgattgtggaaggcgacggcgtgtaccaccgcatcgaggagtacctcgaccacatggcacccgatttgcataacaagctcgagagatgggacccggaagagcacggcggaaaggacgtgttcgacaggtggcagatcgactcgcagctgcgcaagggcatggaacgccaggtctacctgcccagtggcggctccattgtgatcgaccgcaccgaggcaatgacgacgatcgacgtgaataccggacgtttcatcggcaagggcaagtcgctcgaggagacggtgacgcgatgcaatctggaggcgagcgaggagatcgcgcgccagttgcgcctgcgtgacatcggcggcatggtcatgatcgactatgtggatatggtgatgccggcgaaccgcgacctcgtgctgcgtcgtctggtggaatgcctggcccgcgaccgcaccaagcaccaggtggccgaggtgacgtcgctcggactcgtgcagatgacgcgcaagcgcatcgggcaggggctcgtcgaggcgttctccgaggagtgcccggagtgcaagggacgcgggttcattgtgcatgacgagcccacgatctccgcggaattcgacgatccgtacgcgatgaagggcggcgatccgttcgtgcgcacgaacaagcacgggcatggcacgcccgaagtacatgcgccgaagggctcgtccgcggcggtcaaggccaagctcgcgcagattgccgccgcggcggtggctgcgaatgtggccgcggaggccgaggagagtgtggaggctccggcggccgacacgacggaggaaaccgccaaggtcgacgtggcagtggaatccaccgtggaatctgcggcggaatctgcaggcaacgctggcgacaccgaacgcgtcgagcaggtcgaaggcgaagtgatcgacgacgccgagcaatctgccgatgacgccgccgcggtgacggtggaggacgcggccgaggaatcctgaacctggcgccggttccgcgggcgggcaagcgcgaacaagtgtgaaagagctgtgaagcatgggcgaatacgcctgcccgtgcggcacaagggagcataatagaggttgtggcggttcaccccttctccaaagaaccgccgacatattcgtaatggccgattacccaaccggctgttataatatctccttctctctctggggcgaccgttttcccgcggccgcccctcctcgtatctgcgtatctgccgatttgcagacgtgtcatgcgtgcggtttcgttatcactgcgcgcataggcgagtgaatggcgaaaggaagactgaagtttcgtcattcgcgcggtaatctgcgagccgattacgaaagtggtatgcagatttcgtcgtttcgccgcggggagccgagcaattgacaaaagatgtgatgcccgcagtgacaagacatgctgtagacgggttgtgcgggaatgtgaaactcatgccggcacagatgtcggtgcccagcgagccggtagaatgacgagcagagaaaatgcccgcatcaacggcgatgtggcgttttcctgtacatagcatgtcttgtggcgtccagaaattcgcagatttcgtaatatgttcgtagtaattcagtttcgaatacgctgcaaagcctctttgaggtcaatgttctcaacagatttcgaaatattgtgcatatggacacgcgtcttggcgttcggtcggaagcgcgcgtatgataggcacggtggttgattcccgattctagcaggttctactagtaggttctattagtgttgagacccgactcctctccttatatcgaccggggctgtttccaccttccatgccccggtcttctcttgccccgtggaatctgcgtgttgaaggttgcgttgttcgcgggggtgtgtatagttgattgatggtgtctggccgtgagctcgtgcgtgctgggcagtaagctttccaagtgaataaaggaacggatatgtacgcaattgtgaaggccggtggccatcaggaaaaggtcgaggttggcgacaccatcctcgtgaaccgtctcgacgcaaagaatggcgaaaccgtggagttcccggttgcgctcgtggtcgacggcgaaaaggtcatcatcgccgctgccgatctggcaaagatctccgtcaaggccgaagtcgtgaacgacgacgccaagggtccgaagatccgcatccagaagttcaagaacaagaccggcgttgcccgccgcaagggccatcgccagaagctgacccagctcaagatcacagcgatcgcctgagcaagctgacagcaggtacaggtaccgaaaggaacaacaatggcacataagaagggcgcgtccagctcgcgtaacggtcgcgattcgaatcctcaatacctcggcgtgaagaagttcggcggcgaagcggttgtcgccggcaacatcattgttcgccagcgcggcaccaagttccacgccggcaagaacgtgggcgtcggcaaggaccacacgctgttcgctctggctgacggcaacgtgcagttcggcgtgcgtcgtgaccgcaaggtcgtcgacgtcgtcaccgagtgacgcattcgcgtacagcacactttgaaagcctccgcccgttgtggcgggggctttcgtgttttcggcgaggtcgtcgaatgcgcacgcgggaatctgcagaacgggcacgcggtatggaaatggttcggcgccggaatctgtagaacagtgcagcaatagaaacacaccgatagaatgaggcgttatgagtgattttgtggatagagtgaccgtacatgtgaaaggcggcgacggcggcaatgggtcggccggcatccgccgcgagaaatacaagccgttggcggggccgaacggcggcaatggcggcaagggtggttcggtgatcctcaaagccgatcagaatgccacgtcgctgctcgacttccgcttcatgccgcatcgcacggcggattccggcaccatgggtctgggggacacgaaagacggctcgaatggtgcggatctcgtgctgccggttcccgtgggcactgtggtgttcgaggcgcgcggcgcgcagggtttccccaagaagccgggtgcggtgcttgccgatctgcgtcatgccggtgacacgtacgtcgcggcggcgggtggcgcgggcggcctgggcaacgcggcgctggcgaacaggacacgccgtgcacccgggtttgcgctgctcggcgaaccgggcgacgaacgcgacatcattctcgagctcaagtcgatcgcagacgtcgcgctcgtgggctttccctcggcgggcaagtcgtctctgatcgctgcgatgagcgcggccaagccgaagatcgcggactacccgttcaccacgctcgtgccgaatctgggcgtcgtgcaggccggcgacatgcgctacaccatcgccgacgttcccgggctcattccgggagcctcgcagggcaagggcctgggactgacgtttctgcggcatatcgaacgcaccgagatcattgcgcatgtgatcgactgcgtgacgatcgatccggatcgcgacccgctctcggactactacgcgctcgaaaaggagctcggcgaatacgcggacgacctcgatctgccgctcggcgcgattccgattcccgaacgcccgcgcgtgatcatcctcaacaagatcgacgtgcccgacgccaaggagctcgccgatttcgtgcggccggaattcgagaagctcgatctgccggtctatgagatctccacggcctcgcatgccggtttgaaggagctcaacttcgcgttggccaagctcgtgaaggagatgcgcgcgcagattgccgagcgcgaggagagcgtcgacgaggagcgcgtggtgatcaagccgctcgaggaaccgggcacgcagcgccgcaatgggcgcaatgcgcaggtgcgcgaattcgagatcgaacgcgaagacgatggccatggcaacttctggttcaccgtgaccggcgtgaaacccgaacgctgggtgaggcagacgaacttcgacaacgacgaggccgtggggtacctggccgaccgtctcgccaagctcggtgtggaggactcgctgcgcaagcacggcgcccatgccggcgacgaggtgcgcatcggtcgcggggagcgtgccgtcgccttcgactgggatccgacgattgccgccggagccgagatgctcgacggcacccagctcggctcccgtggcaaggacctgcgtttggaggaggaggacggtcgcaaacgccgccgcaccaactccgagcgccgccgcgaataccatgagatgatggatgctcgcgccgccgtgcgcgccgccatgcaggccgagcgcgccgcagggcattgggcggatccgtcgatcgacgacgacaggcacgatgagcagtcgttgttcggccgtggcgaggtggaggaatacgaggatgagcccggcgctgacgggtcgcgtcagctggactgagatccggcacggtagaggaaacagcagcgagaaggaccgagaagaacagtgagtggagctatgcagaccccgtcccaggaggaagtacgccgggcggtggcagccgcgcgaaccgtggtggtgaaggtggggtcgagctcgctcacgcagccgtccgggcacttggacgtagacaagctcaatgcgctggtgggcgcgatcgcgcaggtgcgcatgctcggcggcaacatcgtgctcgtctcgtccggcgccatcgccgcgggtttcggtccgctcggcttcgaatcgcgccccaccgatgtggccacacagcaggcgaccgcgtcggtggggcaggggctgctcatggcccagtacgagatggcgttcggccgctacggcattcgcgtgggccagctgctcatcaccgccgaagacacgatgcagccacggcagtaccgcaatgcgcggcgcaccatggccaagctgctcgaactcggtgtggtgccgatagtcaacgagaacgatgcgcttgccagcaacgagatccgtttcggcgacaacgaccggctttccgcgctcatcgcgaacatggtgcgtgccgacgcgctgattctgctcaccgatgtcgacgcgctctacaccgcacccccaagcgaaccgggctcccatagaatcggcttcgtgccgaacatcaccgaactgctcgatcaggtgcgtgtgggcggttcagagtcgggcgtgggcaccggcggtatggtcacgaagctcgaggccgcgcgcatggccgccgtctccggcattccggccgtgctcaccgccgcccgcaacgccggtccggcactcatgggcgatgaggtgggcacggcattcgctccggtgaagcaacgcggttcggcgcgcaggttgtggatcaaattcgcggcccatccgcgtggagtgctcgtggccgattccggcgcggccaaggcggtgcgcggcggacgggcgagtctgcttgctgcgggtgtgctcgaatcgcgtggtgatttcgccgccggcgacccggtgtggatcgacgacgaggcgggcaatcatctggcgcgcggccttgccggttacgattccgaggagattccgaatatgctcggacgcaacaccgcacagctgcgccgcctgcttggcgaggaatatgcgcacccgctcgtgcaccgcgacaatctcgtgctcgtgtgattgccggcctggtgcctcgcgggcagattccggccattgcggccgtctcatatgccggcgcatcggtcttgcaccgggggcatgttgttagtgtttggcagtagcatggagccatgcctacagatcagacgagactcccactttccaaccgcatcgacaaggtcgcgccgagcgccactctggccgtcgacatgaaggccaaggccatgaaggcgcagggcattgacatcatcggcttcggtgttggcgaaccgaacttcgccacccccgaggcgattgtggaggctgcggcggcggctgtggtgaacccggcgaactacaagtactcgcccacaccgggtctgccggaactgcgccaggccattgccagcaagacgctgcgtgattccggctacgaggtggagccggaacaggtggtggtgaccaacggcggcaagcaggccgtgtacgaggcgttccagctcatcgtcaacgatggcgacgaggtgattattccgtcgccgtattggacgagctacccggagatggtcaagctcgccggaggcaagccggtggaggtgttcgccggtgccgacgtgaactacgagccgaatctggatgatatcgaagcggcgcgcaccgatcgcacgaaggcgatcattgtgacgagcccgaataacccgaccggtgccgtgtggagcgagcggacgattcgcgacatcgccgaatgggcactcgaccacaacatctgggtgatcagcgacgagatttacgagcacctcacctatgacggcgtgaagaccacgcacatcggcgccgccgtgccgcagattcgcgaacagctgatcgtgctcgacggcgtggccaagacctacgcgatgccgggttggcgtgtcggttggatggtcgccccgctcgccgtggccaaggccgcgtccaagctgcaggggcatatgacctccaatgtgaacaacatcgcccagcgtgccgccatcgaggccgtgagcggcccgctcgacgccgtggccatgatgcgcgatgcgttcaatgtgcgccggctggccatagtcgccgcgctcaacgacatcaacggcgtgcattgcccgatgccggagggcgcgttctacgcgttcccgaacgtcgaggggctgctgaaccgaccgatgggtccgaacggcacgacgttcaccacctccgccgagcttgccgaggcattgctcgaggagggccatgtggcggccgttcccggcgaggcgttcggcgcccccggttacatgcgcttctcctacgcggtggccgacgaggagattaccgagggcatgcgccgattcaaggagtgggccgaggcctgagcgacgtggccggagccgtttgcatgcagcctaaaatgtgtgcaaacggcaaaggcggcacgcgcgagtggacttcgtcggagcaatccgctactatttcctcttggcggtttcaccggctcggcgacgagctgatggaaacacttagggaagtggcgcaattggtagcgcaacggtctccaaaaccgtaggttgtgggttcgagtcccgccttccctgcaaaggaacccgagtaagttcatatgaagccaatggagggtgtatggcacgcaagaccgatcacggtgaggaagtcatcaagccgaatgtgttcatgcgcattggcctgttcatcaagcagattatcgacgaactgcgcaaggtggtcaccccgacccgcaagcagctgttctactggtcgctcgccgtgttcatcttcgtcgcattgctcatggtgttcgtcaccgcaatggacttcggactcggcaagctctcattcctcatcttcggctgagccgatatcccgcaaatcgcctacaataccgttagcaatgaagaattgctaacggtattgccgttagtagacactggaaagtaccgtgttctcaaggaacacgtaagaatccccacgaaagtgaagccgcatgactgacgaagtgaacttggaaaacattgacgatctgccgatcaatttggacgccgtctcggccgacgacaacaccgccgacgcgcaggaagtgcagattgaccaggtcgaggccgcttccgagagcgaggacatcgccgaaggcatggcctacgatgccgtgagcgccggcgacgacgcgcagccgtcggaccaggcggccgcgcaggaggattcgctcaccgattcggtggacgactccgccgcagtcgattccgacgcccattccgaaggcaccgccgacgaggacacccagcatgccgatgccgaggaagcagccgccgacgaagctcccgaggccgcggccgaagccgaggaagaggcggaggaagacgccggaagcaaggccgtgaaggaattctccaagtcgctgcgcacgctcgaaggcaagtggtacgtgctgcacacctactccgggtatgagaagcgcgtgaagagcaacatcgaatcccgcgtgcagagcttcggtttggaagacacgatcttccaggtcgaggtgcccatggaggaagtggagaagcacaccgagaagggcaagaaggtcgtcacccgcgtgcgtgtgcccggctacgtgctcattcgcatgtaccccgatgagaacgcccgccgcatcgtgcgcgagaccgaaggcgtgaccggcttcgtcggaccgtcccgtgagccggctccgctcagccgcaaggaggtcgtctcgatgatggccccgatgatcgcctcgcatgcgctcaaggaggccggtgacaagccggctgccgccaagaagcgcacgctcgaggtctcctacaaggtaggcgatcaggttaccgtcaccgatggcccattcacgtcgatgtcggccgtcgtttccgatgtggagccggccacgcagaagctcactgtgctcgtgtcgatcttcggccgcgatacgccggtcgagctcggcttcgatcaggtgcagcggctcgacgcctgagccctgctccgccgccgcacactcacgcacactcatttgccgaacgcatcccgcgtcccatacgcgggatgcgttctgttattcaggcagcccgtggcgtatgcgggagtcgtccggaataggtggcataattgtggggttgtgtgtggagtgcgacttcgcatacacaggaaatatcgattgcggaaggcgtgccatacggccgccgccactaccgcgtcatagaaagaagaaccataacatggctccaaagaagaaagtctcggcgctgatcaagctccagatcgaggctggcaaggccaatcctggccagaagctcggcccggtcctgggttcccatggcgtgaacatcatggacttctgcaaggcgtacaacgctgccacgcaggacaagatgggtcaggtcatcccagtcgagatcaccgtgtacgaagatcgttccttcgacttcgtgctcaagaccccgccggcttcggatctgctgaagaaggccgccggcgtcgccaagggtgcctccaacccgctgaccgacaaggtcggctcggtcaccaaggcccaggtcaaggagatcgccgaaaccaagatggccgatctgtccgctcgtgacatcgatgccgcaatgaagatcatcgagggctctgcgcgctcgatgggcatcacggtgaacgactgagctgagaggatagagacaaatggctaagcactccaagaagtatcgtgaagcggccgagcgcattgaccgcaacaacctgtacacgccagaagaggccatcgccctgctcaagagcatgccggcctataacttcgaccagaccgtcgaagccgtgctgcgtctgaacgtcgacccgcgcaaggccgaccagctcgtgcgtggctccgtcaacctgccgaacggcaccggtaagactgctaaggtcctcgtgttcgcacgtggcccgaaggccaccgaggccctcgaggccggcgccgacatcgtcggtgacgacgatctcgtcgagaaggtcgccaacggcttcctcgacttcgattccgtggtcgccaccccggacatgatgggcaaggtcggccgcctcggccgtgtgctcggtccgcgtggcctcatgccgaacccgaagaccggcaccgtgaccatggacgtcaccaaggcgatcaaggacatcaagggcggcaaggtcgacttccgcgtcgacaagaacggcaacctgagcttcctcttcggcaagctctcgttctccgccgaagccctcgaccagaacttccgcgccgtggcagacgaggtcaagcgcctcaagccggccaccgtgaagggtcgctacatcaccaaggcgacgatctcctccacgatgaacccgggcatcccggtcgatccggcctcgatctgatccagatcagcgctctacggcgcaacgccaatccgttcgccgtccagacaccccgtgcagattctgcacggggtgcttgctattgagcccactatttagggcgtgaatcgtacactggaaccatgaccaaattcgaacatgcggacattctcgatttgctcggcggtgacatcgacgacaatgccgtgatgcgactcgtgttcgaatgcctgatcagcgggatcgacgacgaccgcgtggtctcgctgatgaatctgatcggctggcggggttcgttcagttgcttcgcgctcgggggaacgccggcggattccatgggcgccacattcacgcagatcagctcggcggtgcgcgatttcggcggctcgcatgcgatctttggtatgtacgggcggttcgtgatcgcctgcatcgagctggaggcggcggtgagcccggagatagtctgcacggcagcgttgcctgccttcgcgcaatccgaggccgtgtatttgagcccggtccgggaaggcgtgccgggagcttcgcacgcggtgcgtgaaacactgttctcgctgcaggccgcgccgtcgctgagcacgcagtcgcggccgctgcgcgccgacgaactgctgcccgagcgcgcactgctcggcgacgaggtagcgcgcgaggagctctaccgcaacgtctacctggtgttgcatggcgacaacgaagacgacccctcgtacatcaccgtctccacgttcctgcggcacggtggctcgcttgaggccaccgcgaaggaactcaacgtgcacccgaacaccgtgcgctaccgtctgaagaaggcggcggagaccacgggttgggatgccacgaatccgcgcgacgcattcgtgctcaacacggcgattgcgctgggccgcatgcgcgaggccggcgtgcgttgagcgctgtgctcacagaggaatgcacccggcgtacatatccgcatcaataatcgaagtatgacgactgaactgaacggcgactaccggcgcgcccgtgagaaggcgcatgtgatttcgctggataccgtgacctcgaccaatgactatgccgcacagctcgtcgctgacggcagactcgaccgcaatggcatgaccattgtactggcgcgcgagcagacgcagggcaggggcagactcgaccacacctgggtctcggtgccaggcaaatcgttcatcgcttccgtgatctgcatcgtgaacgccgataccgcaaaggacccgcaggtaaatggctggctgcagatgatcgccggcatgtcggtgatcgacgcccttcgcgagaccgtgatgtcggcgaatatggattggctcgaccacaccaggggcaacccctccatgcgcagcgaactccagctcaaatggcccaacgacatcgtctaccaaggcatgaagctcggcggcatactcgcgcagctggtgcagattcccggtgacgagaacagtgtggcgatcatcttcggcgtcgggctcaacctcgatctcgcccccgaccagctgcccaccgcgcagtcgacgtcgttgcagctgatcgcctcgtgcgtcaacggcgcggcctgcgtgcctgccgatcagttggccgatatgatcgccgccggactcgtcaacgccctgtcgaaacggttgtggtacttcggcgagaacccggccggttacgcgcagaatctgcacaggcgcatcgctgaggaatgctggacactaggcaagccggtgctcgtgcaccgcacggatggcacgacgctgacgggcgaggcggtcgcaatcaacgaagacgcctcgctgagcgtgcgcgacgacagcggccaagtgcatgtggtgcgcaccggcgacgtgggcgtgctgccagtggaagactgacgacgcggtatagcgcgcgagtcagcgtgcggaatccgcagaggcgagtaccggcagtgccagcagtgaggcgacggcgatcttgattaggtcgccgggcacgaagacgagcgtggaggcggcggtgatgcccagaggcatgccggtgacggtggactggaaggcggcgccgaagccgtagccggcaatgaggaacccgaatgcgcaggccatgaagcatgcgatgaagcgggctgcgccggcaagtgccgggtgcatatcgtgcttggtgcgcaacgaggtgattgcgcggttggcggtgcccgcaagcacggcggtgagcatcaccgacggcacgaatccgaagaggaatccgcccgaggggccgatgagagacagcgtggagccgccgcccgagaacacgggaaggccggcggcacccagccccaggtacaggacggtgcccgcggtggcgcgacgccaacccaaggtgagcgcggcggtcatgagcacgaaggtctgcagggtgatcggcacgggcgtgccggggaccgggatcttgcccgccatcgtcgagccgcacagcagcagcgccacgatgagcgacggggcgagggtgcggacgagcgacctgagattgacacgggtgacgctatgcataagttcgtgcataagtattccttccgtctctgtgcgtgaccggcatgtgtccagtgtggcgcatggaaattgtgagtgtgcaacgggaacgttacggttcggcaacgggcagtgagattgcccagcctgcgcaatacctgccaaaataggcggaatcataaggctttgcgggcatgctcccgggtgctgctcgtaatcctagacgcaaacacaggtgtgcattttgtagaggtcaccaaaaacgagcggtcagatttgttcaaagcgacgtttcgcgaatattcaaaagagagcaaagttatgcaccatgaccgatactgtctccaaactactcatcgtcaaccgcggcgagatcgccctgcgtgtggtgcgcaccgcgcgtgaaatgggcatccccaccgtggtcgtgtacgccgagcaggaccgccattcgcaatatgtcaagatggcggacgaggcattcctgctctcgggtgacacctacgccgacacctacctcaacgaagacctcctcatagacattctccggcgttccggcgccgacgcggtgcacccgggctacggattcctctccgaagtgccgagtttcgccgacaaggtgattgaggccggcgccacatgggtcggcccgtcgtcgcgcgcgctcaccgatctgggagacaagatcagcgcacgccgcgtggccgtgtacgccaaggtgccgccggtgccgggcatctcgcattcgctcggcgacatgcgcgtgctgctcgacttcgcacacacgcacggctacccgctcatgctcaagcgcgcggacggcggcggcggacggggcatcacgctcgtgcgcgacgacgacgagctgcgcggcttctacctgaaccacaacgccgtgcagggcggcgacctcgacgagtacttcgtggagcgtttcatcgaccatggcaggcatgtggagacccaatgcggccgcgattcgcacggcaacttcaccgtgtactcgacgcgcgactgttcggtgcagcgccgcaaccagaagctcatcgaggaggcgccggccccgttcctgggcgacgacgtggtcgagcagctgcatgcctattcgcaccggctgttcgacgcagtggactatgtgggcctgggcacctgcgagttcatggtgaccgatgcgggcaaggtgtacttcctggaggtgaacccgcgcctgcaggtcgagcatacggtgagcgaggaggtgagcggactcgatttggttcgcgaacaattgcagattgccgccggcggcaaggtctcaccggaaccgaccgcgcgcggccacagtttcgaactgcgcatcaccagcgaggacccgaagacgaacctgacccccagctccggcacgctcgaacgcgtgcagtggccagcgggacccggcgtgcgggtggattccggcgtagtcgaaggagacacgatctcgccgaagttcgactcgatgatgggcaagctcatcgtgaccgcacatagccgccaggccgccgtggcccgtgtgaggcgcgcactcgacgagctgcgcatcgaaggcgtgcccacgcccgtcgaactgtaccggcaggtgttcggcgacgacgagttcaccgccgagcacggccatggtttcgacgtgagcacgaaatggctcgagcgcaaatacctgaaccatgaaccggccaccgtgcacggcggccagccggcttcgctcgatgccggcgcaggggcggcggaacccgaactcgaccatagcgagcaattcgtgatcgaaatgaacaatcggcgcgtggtgctcaatgtgccgagcgatatgttcgccaatctcaccggcgcggcccgctcgcacggcgaacgcaggcccacgcagccattgcggggccagggctcgcaccatgtggaccgcggcaacgcgcgcaccgcggaacgcccgggcgtcatctccgcgccaatgcaggccctggtcacgcgcatcaacgtgagcgaaggccagcaggtggcgaagggcgacctgctcgtggtgctcgaatccatgaagatggagaactacgtgtattcgcccgcgaacggaacggtgaaggagatcttcgcctcgccagccaccggcgtggaggccggcgaaacactgctgaccatggaggtcgccggaacgtcgaaaccagccaatcccaccaccgacaccaccgaggaggcgtgacatgatcgacagcatcgatgccaatctcgccgcggtcgaagccgccgatgccgccgcagccaatggcgcggacgcgcagggggccatgcgccagccgatccgacccgcggtgaccaaggccgcggaactcgcgcgggacgcagagaacagggcgcgcgaccgccagcatgtgaaaggcaagttcacggcgcgtgaacgcctcgacctgctgctcgactccggaaccttcgaggagatcgggcggttccgcggcggtgacatcaacaagggcgtcgccggttccgccgtgatcaccggattcggcgaggtctgggggcgcaaggtggccgtctacgcacaggacttctcggtgcgtggtggttccctgggcgttgcggaaggtcgcaagatctgccatctgatggatcaggcgctcgcgctgcgcgtgccgatcatcgcgctcatcgactccggcggcgcgcgcattcaggagggtgtcgcggcgctcaccgaatacggcaacatcttccgcaagacctgcgaggccagcggattcgtgccgcagctctcattgattctcggaccgtgcgccggcggcgccgtgtattgcccggcgctgaccgacctgatcatcatgacccgggagaactcgaatatgttcgtcaccgggcccgacgtgatcaaggcctccaccggcgagtcgatcagcatggacgatctcggtggcggcatcgtgcacaacgtgaaatctggcgtcgcgcactatctgggcgccgacgaggcggatgcaatcgactacgcgcgcacggtgctcgcctatctgccggccaacagcgggcagacggccccgcgctacgcctatatggccacgcgcgcggaccgcgacatcgccgaacggctcggcaccgtggtgcccgggaacgaacgccagccctacgacgtgctcgacgtgatccgctgcctcgtcgactacggcgagttcgtgcaggtgcatgagctgttcgcgcaatccgccgtcgtcggtttcgcctgcatggacggccagccggtgggcatcgtcgcgaaccagccgaacgtgaacgccggcgcgctggacgtcgattcatcggagaaggtggcgcgcttcgtgcgtctgtgcgacgcgttcaatctgcccatcatcaccctggtcgacacgcccgggtacaaaccgggcgccgagcaggagcacgccggcatcatccgccgcggcgcgaaggtgatctacgcgtatgcgaacgcgcaggtgccgctcgtcaccgtgatcatgcgcaaggcctacggcggcgcctacatcgtgatgggatccaaggcgattggcgcggacctcaactacgcgtggcccaccagccagatcgccgtgctcggcgcggcgggtgccgtgaacatcatccatcgcaaggacctgcagaaagccaaggacgccggtcgtgacgtcgaagcggtgcgcgcgaagtacatcgccgagtacgaggagacgacggtgaacgcgaatctgtcgatggagatcggccaggtggacgcgatgatcgatcccgagcagacccgcgaggtgctcgtggactccctgaagacgctcgcctccaaacgccgcgtgagccgcaccggcaagcatcacggcaaccagccgctctaggtcgggcccagcatgccgggttatccacaccagaccgtgtgcatttgttgacgcgcgggaaaagttatccacaatccacatccgcagaacccatccgtaattcatacccacacaagaaatgagagacagcagtatgagcaccccggaattctttgtgaaccgactcaattcggagccacacgcccttatgttcgccggccagtccacgccatgggtcgtggccgtcaagcagctcatggacgatccagagctggcacagcggctcatcgaccacgtggctgccgcccacgacctgctcaccccggtttcggcgcaattgctggcgacgaccggccgtgagaccgatctgttctccttcgaagcgaacccggccaagctcggccccgcagccgatgccaccgccagcatcgaaggcatcgcgctcgcacagctcggcgccctgctcgacctcgaccagctcggctacacgctggccagtgcgaatccggtggccttgctcggccattcgcagggcattctcggcgtgcatatggcgcaggccatcatcgacgccggctcgatcgaagccgcacgcccgcagatcgacgagattctcgccatcgccgcactcatcggcgcggcaggcacccgcgaggcccgcgcccacggcttggtgcgcaagtacggtgacgccacgccgatgctctcggtgaagggcattctgccggcccaggccgacgagctcattcgccgcgtggacgacgcccgcgggccgatcgccgtggccgtgatcaattccgcgaaccacgtcgtgctctccggccacccgcaggacctcgcctccttcgccgtcgaagtggccaaggagcacaagcaccaggcgcagctgcgcgccgagaaggtgcgtggcggcagcgtgttcgacccggtgctcgaatacctcgaggtgacgctgccgttccacagcccgatcatggaacaggccgtcgagcagacggtggcctgggccgaggaatgcggcatcgacgtggcccgtgcccgtgtgctcgccggcgaggtgctcgtcaatcaggtggattggagcgcgcaggtggcgaatctgttcaaggagaacgatccgcgcacgttgtgggccgtggatctcggtcccggcaccacgctcgccaagctgttcggcacagtggccgaaggcaccggcgtgggtgttgtggaggcggcgaacgttgccgaccgcgccaagcttgccacggagaccgacgcccccgcccgcatgcaggattggacgcagtacgttccgcaggtggtgcggaccctgcagggcgagcgcatcgagaccgcgttcacccgcctgaccggcaagccgccggtgctgctcgccggcatgacgcccaccaccgtggaccccgagatcgtggccgcggcggccaatgccggctactgggccgagctcgcgggcggcggccaggtgaccgccgacgtgttcgaccgccatgtggccgagctcgaggagcagctcgacgaaggccgcaccgtggaattcaatgcgatgttcatggaccgctacctgtggaatctgcagttcggcacctcccgcatcgtgccgaagaagcgtgcctcgggcgccccgatcgacggcgtggtcatctccgccggcatccccgagcccgacgaggcggtggctctggtgaaggagctcaacgccgaggggttcccgtatgtgtgcttcaagccgggcaccgtggaccagattcgccaggtggtgcgcatcgccaaggcggttgcgcccgcgaacattctcgtgcaggtcgaaggcggctccgccgggggccaccacagctgggagtcgcttgacgacctgctgctcaacacgtatgcccaagtgcgcgagcagagcaatctcgtgctcgtcgtcggcggcggcatcggcaccccggaacgcgccgccgactatatctcgggcgaatggtccacacgttacgaccatccgctcatgccggtggacggcgtgctcgtcggcaccgcggtcatgaccgccaaggaggcgcacacgtcgccggaggtcaagcagctgctcgtcgcgacgccgggtattgccgacgccggttccgacgccgcagccgacgtgtttgccccgctcggcgaggcctgggtgccgagcggcaaggccgtgggcggcgtttccagcggcctgagccatttgcacgccgacatttacgaactcgagaacgcatcggcccgctgcggccgcctgctcgtgcgcgtgatgaagcacccggaggagctcgaaagccgccgccaggagatcatcgacgccctgaacgagaccgccaagccctatttcggcgacctgagcggcatgacctacgaggattgggcacgtcggttcgccgaactctcgttcccgtgggccgacggcacgtatgcggaccgctacctgcacctgctgcagcgcatcgaagcacgtgtgattgacctcgaacagggcgagttcacgccgatgttctccacgcgcgccgacgtggagtccgatccgttcgccgcactcgccgcattggtggaggcctacccgcagatgggcgaactcaaggtggtgcccaccgacgaggcgtggttcatcgaactcgtacgcgaataccccaagccaatgccgttcgtgccggccatcgacaacgacctgttgcgctggtgggggcaggaccagctgtggcagagcgaggatccgcgctattccgcagactccgtgcgcatcatccccggcccgatctcggtggccggcatcaccaccgtggacgagcccgtcgccgacattctgggccgcttcagcgatgcgatgaccgcgcgcgtggcgtccaacgcggcttcccggaccgatcgcttcgcattgcttgccgactgcgaggacgccgaggacttcattcgccgcagcccgaacatctcgtggatcggccaccagatggccaacccggccttcggcaccgcccgcggcgacgcgaactacgaactgaagcacctcggccgcgacgagcaggccggcgtggaacagttcgacctcgacatccacctcgacacgttctgggacgacgacccggacggcggcctttccaagcacgccgtgcgcgacatcgtcattccgctcaacgtgacgctcgacgccaccggcatgatcccggtggtcgaccgtgaacgcctgcccgaacacgtgtaccgcatgctcgccgacaccgccggcatcggcaacaccgccatcaccggcgacaaactcgaggcgatgccgcagatcaccgaggtggccgacaccgagaccttcccgttcggccaggcgcatgcgggctacacgctctccgccaacctcggcttcgaccacgaggcggccaccggtggcgcactgccaatggatctcacgccgtcccgcatcgcgcccgacgcactcgtgggaccggcatggccggccatctatgcggcgctcggctccgtcatggtggacgggtacccggtgatcgagggcctgctcaacgccgtccatctcgaccatctcatcgagctcgaggtgagcgaggacgagctcctcgcacataccggcgaggaaatctcgctgacgggctgggccgaaccctacttcgaatccgccagcggacgcgtcgtcaccatccatgtgcggcatacggccgccgacggcaccgtgttggccaacgaaaccgaacgattcgccattcgcggccgtgcctacaacgacgccctgccggccgcggcacccgacttcggcggcatcgatgagcagattgtctccacgccacgccgcatgctgcgtcgcgtgaacgtcagggcaccccatgagatgaccgcgttcgcccgcacttcgggtgatttcaacccgatccacacctcgcaccgtggcgcggcgatcagcggcctgacgcagccgctcgtgcacggcatgtggctctccgccaccgcccagcacgccgtgcaggcgctcgacgagcagggtgcgcactacgagatcgcaggctggacctacaacatgtacggcatggtgcagctcgacgacgaggtggagatctccatcgaacgcatcggccgtgtggcgcacgccggcctcgtgctcgaggtgacctgccgcatcgacggcagcatcgtctcgcgtgccacggcgatcgcccgtgcgccgatcagcgcgttcgtatatcccggtcagggcattcagcagcagggcatggtgcttgacgagcgtgccaagtcgccggccgcccgcgacgtatgggagcgcgcggacaggctcacccgcgagcgcctcgggttctcgattctcgccgtcgtgcgtgacaatccgaaggaactcaccgccaacggcgtcacctaccgtcacccggagggcctgctcaatctcacccagttcacacaggtcgcgctcgccactgttgcgttcgcgcagaccgcacgcatgcaggaggcgggggcagacattcgcccgtcgtacttcgccggccattcactcggcgaatacaacgcgctgagctccttcgcccatgtgatcccgctggagaccgtgctcgaactcgtgttccaccgcggctccaccatgcaccacctgatcgaccgtgacgcgcagggccgttcgaactaccgcatgggcgccctcaggcccaaccagttcggcgtggacgacgcgcatgtgaaggaatacgtggagtcggtggccaaggcgagcggcgagttcctcgagatcgtcaactacaatctcgccggccagcagtacgccattgccggcacgatcgcaggcctcaaggcgctccaggcggattccgctcggcgcgtggccgaatatggcggcaagccggcgttcattctcgtgcccggcatcgatgtgccgttccattcgacgctgctgcgcaagggtgtgcccgagttccgcgacaagctcgacgcgctgcttcccgccgagatcgactaccgtggcgcgctcgaagggctctacattccgaatctcgtggccgcgccgttcgagatgacgaaggagttcgcgcagaagattctcgacgtggtgcccagcgagcgcatcgccgccgcattggccgacgacgccgtgtgggattcctatgccgccgacgaccagaagctcggccgtctgctgctcaccgagctgctctcctggcagttcgcctcgccggtgcgctggatcgaaacgcaggcgctgctgttcggttcggccgaacagggaggcttgggcgtcgaggagattgtcgaagtgggtctgggcaatgcgcccacgcttgcgaatcttgcctcgaagacgttgcgtctgccggagttctcccgccgccatgtgaccgtgtacaacgtgggccgcgacgaaggacgcgtgtatatgaccgattccgactcgctcgtgcccgaggtcgacgatgtgcggacccctgcggccgacccggccgcccctgcgcaggccgtcgccgcagcgaacgcctccgcgagcgtcgtcgtggaaaccgccgagcccgtggcacccgtggcacctgcgggcggtgtttccggcgccaatgtgccggacctcgactaccgtgcccatgacgccatcgagatgctgctctcctacgccgccaaggtgcgtccggagcagatcggcgagaacgacacgaccgacacgctcaccaatggcgtctcctcgcgtcgcaaccagctgctcatggacatcagctccgagctcggcgtggccagtgtggacggcgccgccgaggcgagcattcgcgacctcaatgcgttggtagacaaggttgcgccgaattacaaggcattcggcccggtgctttccgacatcgtacgtgaccgcgtacgcagtctcttcggtgccgccggcgtcaagctgccgcagatcaccaagcgcgtgaccgagacctggcagctcggcgaaggctgggccaaccatgtggtgggccagctcgtgctcgccacccgtgagggcaccagctcccgtggcggcgacctcgccacgctgggcaccgatgcggcgtccaatgcggcggctgcgaacgcattgatcgatgcggccgtgcaggccgtggccgcggcacacagcgtgcaggtggccatgccgagcgccggtggcgcgtccggtggcgtggtcgattcggctgccctcgacgcctacgcgcagtccgtcaccggttccgacggtgtgctcgccgccaccgcgcgtttcgtgctgggccagctcggtctcgccgaaccgaacgcggtggaggcggaagacgagaatgccgccatcgtggccacggtggaggccgaactcggctccgactggccggcacaggtggccccgcgcttcgacgagcgccaggccattctcttcgacgaccgttgggcctccgcccgtgaggacctcgcacgcgcctactacaacggggaaaccgacgcgatcgccggcgatttcaccggtgcgggcgcggcagtggcccggcaggcggcatggtatgcccagcagtccgcgggcagcgcgcttgccgagcagtacgagcgtatcgcacagcaggccatggaatccacgcaatctgcacaccttgaatatgacggcgaagtggcggtggtcaccggcgtcgccccgaactcgatcgcggcacaggtggtgaacggtctgctcgcagagggcgccacggtaatcgcgacctcgcacagcttcaagccgagcgtcaaggcgtgggcgcagcgcacctaccgcgagcatgcacagggcgatgccaagctgtggctcgtgccggcgaatctgtcgagctaccgcgatgtggatgcgctcgtgaactgggtgggccacgtgcagaagaagacgagcggtgccaccaccacggtgctcaagcccgcatacgagccgagcctgttcttcccgttcgccgcgccgccggtgcacggttcgctggccgattcgggtgcattgttcgaatcgcaggcgcgcctgatgctgtggggcgtggaacgtgcgatcgccggattcgcggcgatcggcgccgacaccgacgtgcagcacaagctccatgtggtgctcccgggttcgccgaaccgtggcgtgttcggcggcgacggcgcgtacggcgaggtgaagagcgccttcgacgccatcgtcaaccgtgcgcgcagcgaacaggtgtggtcgaatcgcgtcaccttcgcccatccgaagatcggctgggtgcgcggcaccggtctcatgggcggcaacgacccgctcgtcgaagttgtggagcggcacggtctgaaaacctattccaccgaacagatcgccgaggaactgctcaagctcaccacggcggccgcgcgtgagcaggcgcaggtggcgccgctcgacgtcgacctgaccggcggccttggctccgagccgatcgacatcaaggccctgcgtgcgcaggccctcgccgatgcggctcctgacgcggcggaggagacgtcggaaaccgaagcggacgcgccgatcaaggcattgccgagcccccgcgtgccgcatcaggccgccgtcgacctcgccgaatgggagcgcgtaagcgcgaagccggaggacgagatcgtcatcgtctcgatcggcgaactgggcccatggggatccggtcgcacccgtgcagaagccgagctcggcatccatgcggacggcgaggtcgacctctcggcgggcgcggtgctcgaactggcatggaacatgggcctgctcagctggcaggattcgccgaagccgggctggtacgacaccgacggcaatctggtccccgaaaccgacatcgcggaacgctaccatgacgaggtcgtggcgaagtccggcgtgcggccgttcgaaaccggcatggggtcggactaccgcagcggcaccgacgaggaggaggccgaggtctacctcgaccacgacgtgaccttcggtgtgccgacgcgccagatcgccgacgaatacgtggcgatggaccccgagcacacgagcctggctcaggacggggagagcggcgagtggaacgtcacccgccatgccggatccatgatccgcgtgccgcgccgcgccgcgatgacgcgcacggtgggcggccagttccccgacggcttcgacccgctcaagtggggcatcccggcctccatggtgggcgatgtggacgagatcgctctgtggaacatcgtcaccacagtggacgcctacctgtcggcaggattcacgccagcggagattctcgaggccgtgcacccgtcgatggtcgcctccacgcagggcacgggcttcggcggcatgtcgagcatgcgcaaactctatctcgaccggttcctgaaccacgagatccccaccgacattctgcaggaggcattgccgaacgtggtcgccgcgcatgtgatgcaaagctacatcggcggctacggcaacatggtgcagccggtctcggcatgcgccacggcggccgtctcgctcgaggagggcgcagacaagatcgcgctcggcaaggccgacttcgtggtgaccggtgcgatcgacgacatcggcgtggaatcggtgatcggcttcggcaacatgaacgccaccgccaattcgcaggagatgctcgacaaaggcattgcgccacgcttcttctcgcgggcgaacgaccgtcgccgcggagggttcgtggaatcgcagggcggcggcacgatcctgctcacccgcggcgacatcgccttacgtctgggcctgccggtcgccggcgtggtcggattcgtgcattcgtacgccgacggcgcgcacacctcgatcccggcacccggtctcggcgccctggccgccggcatgggtggccgctcgtcgaagctcgtgcgtgacctggcacggctcggagtcgaccccgacgacatcaccgtcgtgtcgaagcacgacacctccacgaacgcgaacgaccccaacgagtccgagctgcacaacacgctggcccacgccataggccgcgaggacggcaatccgctgttcgtgatctcgcagaagtcgctcaccggccacgcgaagggcggtgcgtgcatcttccaggtcaacggcatcacccaactgttcaaaagcggtgtgatcccggcgaatgcctcgctcgaatgcgtcgaccctaagctcgagcgtgacgacctcatggtgtggctgcgcgagccactgcacatcggttcgcgccacacggtgaaggcggcgttggccacatcgctcggcttcggccacgtgagcggcttcacggccattgtgcacccgggcgccttcgaggccgccgtcgagcacaccgccggcgtcgaggccctcaaggcctggcgtgcacgcgccaacgagcgtctggcagcgggccgccgccacttcgaggagggcatgatgggccgggcggcactctacgagccgatcgacaaccgccgcttccacgaagacggccgcggctacgacgcgcacgaggtggagaaggccatgctgctcgacccggacgcgcgtctcggcgccgatgggtacttcgcctgacggttcacgcggatttcgccgcacatgcgcgaatctgcccgcaatgatccgccactatgacggaacaatgccatgagtttcgccatagcggcgcagattcccgcgtggaggacgaaatctgcggcattcgtggataatcagtgtgttcgccaatgtctcggcgaacacgaaagaccctcgcgaagatggtcgggtaatctgcagccagagcgcagcgagggtggaggtgacgatgatgctcggtctggggcacgatgtggtcgacgtcggcgcgttcgcggaacagctcgagatgccaggcacgcgtatgacgcggctcttctccgcgcgcgagtgccggcaggcgagtctgcgcgcgtcgatcaagcacgacggcgaggcgttgcatctggcggcgaagtgggcggcgaaggagtctgtggtcaaggcgtggtgcgaggcactcgtcggccgtggaatcaccgagcgcccatacacggtggacgacacgccatggtcgcgcatcgagatcgtcgacgacgccacagggtgcccacgcgtcgtcatggcagcggaagtccatgtcgagctgtgccgctcgctggcagtgacggaaagcgctgagccggtctggcacgtgtcgatttcgcacgacggcggcatcgcatcggcggtagccgtgctcgacatgcgggagtgaccgccgtggattgcctgcggggggagggttgtgtataatggcaacgttgcctcggcacacgcggatgtagctcaatggtagagcctcagtcttccaaactgattacgcgggttcgattcccgtcatccgctccactcgaaatggctggatgtgaatccagccattttcgctatatggcagaatatgcagcagcacgaacggggagggcacgcatgccggattccgagcagcaggagatcgccaggctccgatccgagcctgccgccacaccgacgacgccgagcagcgcgggcgtgatggcccagaacatcgtctcgaagcaccccgaggcgacgataccggaatctgacatctcgctggccgacatcgaacgcaagcagtcgaacccggtgaagtggaccgtgtcaatcgtgctcgtgctcgccgcgctcatcgcaccgttctgggtggggcgctcgttcgccgtgcacagcaccgcccgcgtgatcgagcagctcggccacttcacgtcctacggcatcgctctggtgagctggggcgtgaccacgatgatcttcgtctcgctcatcatgatgatcgtggacaaccgccgcatggcatggttcggctcgttcatcgtcttcctctcgctcgaacagttcataggcggcctctcgctgttcaaactgaacttctggagctccacgtacgtgatctacggcagtcatgcctatgtggcgaatgcggcgaatctgggcgtcatcgcgtcggcgctcgcgctcgccgtgttcgcgatcgtgtgggtcggtctgctcgtcatgatccgcaaggattcgccgctcaacgtgctcacccatgtgtgggtctcgttcatcatgttcctcgtcttcgagctggccgcgctcgcgattctgttctgcggcggattcatggccgtcgcatagcacacccggttgccgtacctggtttgtctcaccaagaggacaccaaggggaaccgaggacgcggacgaagtcggatcatagaatatgcgtgcgcgcaaggttctctttcacgtgtgcgcagctcttgcggaattcgtcgatctccgcgtcggacagatcgaggcgcatgacctcctccacgccgtcggcgcccaccacgcacggcagtgagatgaagaagccctcctcgccatattcgccggtgagcagcgtggagcatgcggtgatgtaatgctcgttcgagatgaccgcgcgcacgagtctgcacgcggcgtcggccaccgcgaactcggtgcagtgcttgccggcgtacgtgacatatccgcccttgcgcgcctcggcctcgagctcggcgtagtcgaaggcgaagcgctccggctgctccatggcaagctgggagagcggcttgccaccgaaatacacattgctccatgcggcgaactggctgttgccgtgctcgccgagcatgtatgcggtgatcgaatgctggtcgtagccggtgacgcgcgacagcacatacttgagtctgctcgaatcgagcgcggtgccggtgccgatgatgcgccgcggatccatgcccgattccttccagatttcagtggccaccacgtcgcaggggttcgcgatcgtgatccagatgccgtggaatccggcgtccgcgatcgtcttgatgaacgtcttcgccgtgtcggtggtgaagaagagctcgccgtcgcggtccttggacgacagcgagacgtcgccggcgcagttcacgatcacatcgcactgcgcgagctgcgcgtagtcgtcgccgcagttgtgcagcgccacattgtgcgggcagaatgcgagcgaatcgccgaggtcctgcacttcggcggcgagtttcttgctgcggtcgcgctcgcccgagcagatctcggtcatgtacagttcgtccgcgatgccctgcaacaccaggctgttcgccacgtgcgcgccgacgtgacccatgccgacgatgccgatcttcgtgcagattcccatttcctcttctcctctctcatgcgtctgtgacgcgggtgtgacgccgccccgcacagattccgcgaatgcggggcggtaaatgactctgagtatatgaagcgcagatatcgtcaaaagctggtgtgtcggtcgcgtacgtcgtgggcgaacaaaaaggccgcatcatggtcgcctgaggctgtggtgtgcgtgaggatgtccatcgtccgctccagtgcgtagaatggtcgattggcgtgtttcgcccgcggatagagagcgctccggcatgaggtcggtggcaccgcgcagttacaaggaggatgccgtggcactgacggctgaagaaaagcaggacatcatcgctaagtacgctacccatgagggtgacacgggctccccggaggtccagatcgcactgctcaccaagcgcattgccgatctcaccgagcacctgaagttccacaagcacgatcaccactcccgtcgcggtctgctgctcatggtcggcgatcgtcgtcgtcttctcgactacctgaagaaggtcgacatcgagcgttaccgctccctgatcgagcgtctcggcctgcgccgctagtcttgtgcccgagctctgccggagttcgggcctttttgtattcggttcgtacccggcaatccgcaaatgggttcgtggattgccggattgccgtggaatgctgggagcgcatgcggaagatgacgtggccgcctgcgacatcgcttaattcgtgagagaacccacgcgggggcgcgcgggaggcggtatacaatctgaagttggtgagaatgcgccgggacggcgcaatcggcatgttcgccggcagggtaccggcgatgcgggatacgcccgtgggtgcgtggatgcttgcgcgcctgaatgtatgtaggtaaagaaaaaataactaaaggaggaaccctatggagggtcccgaaatcaaggctgttgaagccgtaattgacaatggttcgttcggcaggcgcacggtgcgcttcgagaccggacggctcgcccggcaggcggacggcgccgtggccgcctacctcgacgacgattcgatggtgctttccaccacgaccgccggctccagcccgaaggagaactacgacttcttcccgctcaccgtggacgtggaggagaagatgtacgcggccggcaagatccccggctcgttcttccgccgtgaaggccgcccgagctccgaggccattctggcttgccgcattatcgaccgtccgctacgcccgctcttcccgcacacgctgcgcaacgaggtgcaggtcgtggagaccgtgctcgccgtgaacccggaggattcctacgacgtgctcgccctgaacgcggcctccgcctccacgctcatctccggcctgccgttcaccggcccggtcggtggcgtgcggctcgccctgatcgacggccagtgggtcgcgttcccgcgttggagcgaacgtgagcgcgccgtgttcgagatcgtggtggccggtcgtgtggtcgaaagcggcgacgtcgccatcgccatgatcgaggccggtgccggcaagaacgcatggaacctcatttatgacgaaggccagcagaagccggatgaagaggtcgtggccggcggtctggaggccgccaagccgttcatcaaggtgctgtgcgatgcacagaacgagctcaagcgcctcgccgccaaggagacccgcgagttcacgctgttcccggagtacactgacgacctgtacaaccgcatcgacgagatcgcgcacgccgacctagatgaggcgctgtcgatcgccgagaagctgccgcgtcaggagcgcatcgccgagatcaagcagcgcgtcaaggacacgctgtccgtcgagttcaccgacatggacgagatggagaaagacaaggagatcggcaacgcgttcaaggagctgcagcgccagatcgtgcgccgtcgcatcctcacgcaggactaccgcatcgacggccgtggcctgcgtgacatccgcacgctctccgccgagatcgacgtggtgccccgcgtgcatggctccgccctgttccagcgcggcgaaacccagattctgggcatcaccacgctcaacatgctcaagatggagcagcagatcgacgccctgtcgggcccgaccaccaagcgctatatgcacaactacgagatgccgccgtattcgaccggcgagaccggtcgcgtcggctccccgaagcgccgcgaaatcggccacggcgccctcgccgagaaggccatcgtgccggtgcttcccagccgtgaggagttcccgtacgccatccgccaggtctccgaggccatcggatccaacggttccacctctatgggttctgtgtgcgcctcaacgctgtcgctgctcgcagccggcgtgccgctcaaggcaccggtggccggcatcgcgatgggtctggtctccggtgacgtggacggccagcacatctacaagacgctcaccgacattctcggtgccgaagacgccttcggcgacatggacttcaaggtcgccggcaccgccgacttcatcaccgccctgcagctcgacaccaagctcgacggcattccggccgacgtgcttgccggtgcgctcaagcaggcccatgaagcacgcaagaccattctcgaggtgatcaacgagtgcatcgacggcccggccgagatgagcccgttcgcaccgcgcatcatcaccaccaccgtcccggtggacaagatcggcgaggtcattggcccgaagggcaagatgatcaaccagatccaggaagacaccggcgccgagatcgcgatcgaagacgacggcaccgtctacatctcctccgaaggtggcgaggccgccgagaaggcgaagcagatcatcgacgagatcgccaacccgcacgtgccgcaggccggcgagacctacaagggcaccgtggtgaagaccacgtcgttcggcgccttcgtcaacctgacgccgggcatcgatggcctgctgcacatctcgcagattcgcaacctcgccgatggccagcgcatcgacgccgtcgaggacgtgctcaaggaaggcgattccgtggaggtcgtggtgcagggcgtcgacgaccgcggcaagatctccctggccatcccgggcttcgagaaccaggagaacaatgccggtggacgccgttccgacgaccgtccgcgccgtgatgaccgccgtcattccgacgaccgccgccgtgacgaccgtccgcgccgccgttccgacgaccgtgaccgtgactacgacgaccgtccgcgccgtcgccgtgactacgacgatgaccgtgattacgatgatcgtccgcgtcgccgctcacaccgtgactacgatgacgatcgcgattacgatgatcgtccgcgccgctccgaccgtcgccgtgactacgacgatgaccgtccgcgccgtcgccgcaatgatgatcgcaatccgcgctatgtcgccgatgagaactacgacgaataccgcgagggacgtgaggtgcgccacgagcgtccgcgtcgtcgtgtgcgccgcgacttcgatccgttcgacgactgagccgaacatccgggcgttctgaatcgactggatcgatttagatagcgtgtttgcataagggaggatccggcaatgccgatcctccctttgtcatatccgggcgccttccatccatgtgtcgagacggacagacatctatgtggtgtcggggaatccggacattcgcagccatgctgatgggcgtgatccgcaaagcctctcatgagctggacaccgattatgtgagggtatggtgaaatgcgataatcgtgccattgcgtgcgcaccgggcgcatggaaggagaagatatgagcggttggattatcgcgctgattgtgattgcaatcattctcgtgctgacaatctgggtcatcggcatgtacaacagtctcatcggcatgcgcaaccgggttggcaacagctgggcgcaggtggatgtgctactcaagcagcgtgcggatctcattccgaatctcgtggaggtcgtgaaagggtacgccacgcatgagtcgaccgtgttcgaacaggtgacgaaagcacgcgccggcgtcgtggaagtcgcgaacaacccaaattccacgctcgagcagcgcgctgcagccgagcaggcactcaccaacgcgatggtgaatctgcgggcgattgtcgaagcatacccggacctcaaggcgaaccagaacttcctcgacctgcagggacgcctcgccagcctcgaagacaagatcgcctatggccgccagttctacaacgacaccgtgctcaagtacaacaaccgcatcatgcaggtgcccacgaacatcatcgccggcatgttccacttccagccggcccagtatttcgccgcggacgaggccgatcgctcggtcccgcaagtcaagttctgagttcccgcgccccgcgtatgcgcatggccgtatacgcggggcgttcgtatactctgcgcgcttcgcgtgcgatgcaaggacatcgatgaagaaactctcacgctccgttttcagctcattcaccatcagctgcatcatcattgtggcgacgctgctcctcggctacttcgtggccaccgacgccaacaattcggatctgagctaccgtgcgctcgactacaatgtgcgggtggaagacaacggcgatctgcgcatccgcgagaccgtcgacgtcaagctcgactcccgcaaggacgaagatgacaatccgaagccgtggaaacagctgtaccagcagtacacgctcaggtcgtcgaatctgaccaacatcacgaacatcagcgtgaagaacctcacctcgggggaggaatacacgcagaccgaaccgcagtcgccctccggcatctcgaactccacctggaacgagaagttcgccagacgctggtacatagccgatgtcaccgacggcgacacgaacccgaagccctatgaaccattgaccgacggtctcgcctcaagcggcagtgatggtgtggtgacgaagacggtggagataggttggaacatcccagccacacaatcgtccagcagcaagcgattccagatcgacatgacatgggagggcgtgacgaccgcctacaacgacgtcgcgaaattccagtgggagcccttcggtgcgaagaaccagacgccgatcggcgtgatgacgacgaccgtggagttccccgcaggcgtgacgaggagcgactcgtgggcatggctccattacagcggcaactcaagcacggagcgaacggccaacgggctcaagttcaccgcctacaacgtcagatccgggcagtacctcgacctcgtggcgatgatcggcgccaaccacatgcatggtgtgacacgtcatgtggacgaagacacgaagcagtggacgctcgacgacgaggcccgtcaggagcgcgaatggcatgagcggcaacgccggaatgcacagctgcgcatcgtgctgtgggttgccattgcggtggcaggtgcgctgctcgcgttcttcggcatacgttccgccattcgcagcgtggatgcggccaaatacaagggcaacatcgaatactggcgtgagccgcccaatatgagccctgcggcggcggcccagctctacgacatcgtgatgggcgtgcgcaatggtggggtgacactcgcgaaccgcgagatggcgtcgaccatgatgtcgctggtgagcaagggggcaatcgccgtgtatccgggcaaggccgaactctaccgtggcatcgacatgtcgcgcgccaactcggccggtctcgcgcagatgctttcgtcgaatggggcgagcgagaaggagctcatgaagacgagcacgattgtgatcatgccgcgcgcgctggccgagcatcatgaggagctgaacctatgcggttcggaggaacgtctgctcggcattctgatggaggcgtacaagcgcatccactcgccggtgttcgacctcaggcagatgaacaaggcgttcaggaaatggacgaacggatacaaggcgatcgagaagttcaatgcggcctgcaaggccgaactcgaatcgctgcacgccaccagatccgtcggcacggcggcggtgacctgcggcatcctcggcatcatcgtcggcattgcaagcgcgttctacttcattgcggcggagcataattttgcactcgcattgtgcatcagcctgccgatcaccgtgctgtgcctgttcgcgctcgtctactgcaccaccaccggcatcaccgattccggccagcagtatgcagggcaggtgcgagggctggccaaatacctcgaggacttcagtgagttcagcgaccgcggcgtgctcgacctgacgttgtgggaccgctacctcgtgtatgcgacggcattcggcatctcgaagaaggcgctgcggcagctggccgccgcctacccgcaggtcgccgatcaggattggctcgattcgaacgcctcgaatctcggcctgctctactggtccaccagaccgtcgacgatcgtcggttcgggcattggcaatgcgctcgccaacggcaccggctcgtttggtggtttcgccggcggattcgtggacatcggcacgcagctcaattcgggcttctcgtcgattcagtccacaatccgttccgcggccccttcgtcaagctccggttcgggcggctcgttcggtggcggcggtttcggcggctccggcggtggttcgggcggcggctcattcggcggccgttagaagtcccaatcgtcgtcgtcggtctcctcggccctgcccatgacgtaggagctgccggaacccgagaagaagtcgtggttctcgtcggcattcggcgagagcgcggccaggatcgccgggttcacgtcgcagatctcgctcgggaacagggccgggtagccgaggttcatcaacgccttgttcgcgttgtagtgcaggaacttctccacgtcgtcggacaaccctacctcgtcgtagagcgagtgcgtgtactcgacctcgttctcgtacagctcgttcagcagatcgtaggtgtaggtctccatctcagcgcgcttggcgtcgctcgccatctcgaggcctttctggtatttgtagccgatgtagtagccatgcacggcctcgtcgcgaatgatcagtcggatcacgtcggccgtgttcgtcagcttcgcatggctcgagaagtacatgggcaggtagaagccggagtagaacaggaacgattcgagcagcgtcgacgccaccttgcgcttcagcgggtcgtctccctcgtagtagtcgagcacaatctgcgccttgcgctgcaggtgcgggttcttttcgctccagtcgaaggcctcgtcgatctcgcgtgtggagcacagcgtggagaagatcgacgaatagctcttcgcatgcacgctctccatgaacgcgatgttcgtgtacacggcctcctcgtgcggggtgagcgcgtcgggaatcaggctcacggcgcccacagtgccctggatcgtgtcgagcagcgtgagcccggtgaacacgcgcatcgtgagcgtgtgctcggcgtcgctcatctgccgccaatccggaatgtcattcgaaaccggcactttctcgggcagccagaaattgccggtgagacgatcccagacctccaggtccttctcgtcatccaatcggttccagttgatggcggtaacgcggtcgatgagttttggcatgacagatcctttcaataaatttcggcgaatgcgtgcccgtcagagcatgcagctgacgcagccggcgacttcggtgccttcgagcgcctgctggcggatgcgtatgtaatagagcgtcttgatccccttgcgccacgcatagatctgcgctttgttcaggtcgcgcgtcgtcaccgtgtcggggaagaacagcgtgagcgagagtccctggtccacatgcggcgtggcctcggcgtaggtgtcgacgatcgctttccatccgatttcgtaggcgtcgtcgtacaggtcgaggttgtcgttcgtcatgtatggcgccgggtaatacatgcggccgatcttgccttccttgcgaatctcgatcttcgaggcgatcgggtggatcgaactcgtggcatggttgatgtacgagatcgatccggtgggcggcaccgcctgcagatactgattgtagatgccgtcgcgcagaatctcgccctgcagttcgcgccagtcgcgtgcggtgggaatccgcacaccgaagcgttcgaacagtgcgcgcacggtcccggtacgcggttcggtgtcgagggagccgtcgagatacttgtcgaagtaattaccgtcgctgggctgcctggcgtacgcggagtcggcgaagcgcgcgaacgcgtggccgttctcgacggcgagggcatgcgaggcgcggtaggcgtggaacgcgaccgtctcaaaatacatgtttgtgaaatcgagcgcttccggtgaaccgtaccgtatgccttcgcgggcgaggaagccgtgcagattcatctgaccaagcccgatggcatgcccctcctcgttcgcgcgggcgatcgagggcaccgcgccgatatgcgtgtgctgcgagaccgcggtgagcgcgcgaatcgccgtctccaccggaccggcgagcccggcgtccatcgcgcgcgcaatgttgagcgaaccgagattgcagctcacgtcacggccgacatgcgcatagctcaggtcttcgtagtacgtgctcggttcctgcacctgcagaatttccgagcacagattgctcatcgtgatgcgcccgtcaatcggattcgccgcattcgccgtgtcttcgaacagcaggtacgggtagccggattcgaattggatctcggcgagcgtggtgaagaactcgcgcgcgtcgatgaaggtcttgcgaatgcggtcgtctgcaagcatctcctcgtattttgcagtgacattgacatccgcgaacggcacgccgtacacgcgctccacgtcgtacgggctgaacaatgccatcttctcgcggcgcttcgccaactcgaacgtgatgtcggggatcaccacgccgagcgcgagcgatttgatgcggatcttctcgtccgcgttctcgcgcttggtgtcgaggaacttcaggatgtcggggtgatgcgcgtgcagatacaccgcgccggcaccttggcgagcgccgagctggttcgcatagctgaacgagtcctcgagcagtttcatcacggggacgactccgctcgactggttctcgatgtgcttgatcggcgcgccctcctcccgcagattgctcagcagcaatgccacgccgccgccgcgtttgctcagctggagcgccgcgttgatgccgcgtgagatcgactccatattgtcttcaatgcggaccagaaagcagctgaccggctcgccgcgctgcgctttgccgaggttgagaaacgtgggcgtggccggctggaaccggccgagcacgatctcgtccagcgtgcgcatggccatcggctcgtcgccgtcggccagcgcgagcgagacggcggccgcgcgctgcgggaagtcctccaggtaatgctcgccgtcgaaggtcttcaacgcgtaggagcggtagaacttgaacgcgcccaggaacgtctcgaaacggtgcggcaatgcgtcggcatgcgcatagaacgcgtcgaggaactcgggggagtatttgctgaacacgtcgtattcgtagtagtggtggtccaccagatagcgcaggcgttcgcgggtgctttcgaaacggatcatgcgcggggccacgtgttcggcgaggaaggcatccacggcctcgtggtccttgtcgaactggatgttgccgtcctcgtcgtagaggttcagcatggcattgagggaatggtagtctgcggtcattgcggtctttcagtcggtgggggtatcggagaagaagcggcggacgccctcgcgcacggcatggacgtcttcccgggtgcccatgagttcgaagcggtacatgagcggcacatggcatttgcgggagatgatggggccggcggccgcgtacgcctccccgaagttcgtgttgccggaggcgatcaccccgcggatccactcgcggttcgcggggtcgttgaggaagcgcttgacttgcgggggcaccgctttgcgcgcatcgccgccgccataggtgggcacgatgatgatgtacggttcgcgcacgttgagcggtgccgcattgggctgcagcggtatgcggaacacgttgacgccgcacgaggggaaatcgcagtgttccacgaaccgttcggtgttgcgcgacgccgacgagaagtagacaacggcgctcatgcgagcacgccgctcgctgaggagaccgtctgcagtctgcgtgcgacatcgcgaattctgtcggggcggtagccggtccagaagtccgagtccacgaacactaccggcgcctgacggaaaccggcttcctgcagtgtggcgagcgcgaccgggtcggtggtgatgtcgacgacggtgtagggggcgccgagtctgtcgaacgcgcgtttggtggccgcacactgcgggcagttcggtttcgaatagatggtgatgtgcattcggttccttccgctgtgcatgggtgggtacgtctgccaaaaacaataccttgtgtttgagtttgcagtgaaccactacatctagtgtttcggtgtgtgaggaacgccacaaagcgcccgctgcgtgcgtgtttcaacgcgtgttgcgcgcggagtgtggatgcgcggctgtcgggagtgtgagatttcccacacggcacgccgtcatgttcgccgccagcatgcccgggtgtgtcggaggtgaggcgcagtctgttcccgcgcgcgcataccatgtaaggaaacaccggtagcagataaggagcagcatggtattgcataggaatctgggcccgtttgacaccacggccataggcttgggcgagatgccgctgacgatcgagaacaatctggggccaaagatgggtgtggagaccattcacgccgcactcgatgcgggttgccgccagattgacacggcatgggcgtactactgctccggaggcgaggagcagaccggcgagaagctcgtgcgcgaggcgctcgccagctgggacggtccgcgtgacgaagtgctcgtggccaccaaggtggggcacttccgcaacttcaccgacggcaaacccacctgggatgtggacggcagcccggagaacctgatcaaacgcgccaagcagagcgcattcgaactcggtgtcgacatgatcgacctgctgtacttccaccgccccgacccgaagatcccgtacggcgaatcatgcgaggcgatgaaggagattcgctccatgggcatcgcgcgcgagatcggcatttcgaacgcgtccatcgagcagatcgacattgcgcgcgagattctcggcgactcgctgatcgccgtgcagaaccagttctcgccgatctacaccgagacagccgacacactcgactactgcggcaaggtggggctgagcttcgtgtgctggagcccgctcggcggcttccgcaagccgaaggacgagtcgaagttcgacccgttccgcgaggtggccgaagcgcatggcgtgagctaccagcaggtcgtgctcgcgtgggagctcgccaagggaagccacgtgttcgtgattccgggtgcgcaccgccccgccacgatactcgactcgctcaaggccggcgatctcgaactcacgccggaggagctcgccaagctcggctgagtccgggcgcccggcataggttcggcataggtcatgcggcacgttgcgcggaatttccgtgtggcgtgccgttttgatgtctcgttgtggttcgtttcgcggaagcatccgtgtgatgtgccgcagatgccccctctttgcggtcggttgttaggaaggttccgtgaaatgggtcgcggaacggtctggagacggcacggcatacggaatgttcccagagacggggcatggctgtgccgcccgctatactgtgtggtctgcatatcccatgtggtctgcattcccgtgaatccaagcgaagtgtggtggcatgaaacgtcgtggcaaaccagaggtgctcgcgccggcaggcaatctgcgcgggttgaagaccgccgtcgattacggcgccgacgccgtgtattgcggcggcaagtcgttcggcatgcgttcggcgccgcgcaatctgagcctcgacgacttccgcgagggcgccgcgtatgcgcatgagcgcggcgcgcgcgtctatgtcacgctcaacattctgccgcgcaacaacgagatcacggcgatagaacggtacatcgaagatctgcgcaccaccggcgtggacgcgctgatcgtcaccgacatcggcgtcatgatgctcgcgcataggatcgcgcccgaactcgaactgcatgtgagcacgcaggccggtgtgacgaattacctggcggcgaatgcattgcatgacctcggtgcgcgtcgcgtggtgctcgcgcgcgagatggatttgcaggcggtgcgcgacattcgcgcgaacattcccgacgacttagacatcgagacgttcgtgcacgggtcgatgtgcatggcgttctccgggcgctgcctcatctcgaactacctgaccggccgcgacggcaatcatggcgaatgcgcacagccgtgccgttggaaatactcgctcgtcgaggagaagcggcccgggcaggtgttcccggtggaggagaccgcgcaaggcacgtatctgttcaattcgcaggacatgaacatgatggcgcatctcgacgatctgatcgattcgggggcgacgtcgttgaagatcgaagggcgctcgaagtccgcgtactatgtggctgcgatgacgaacgcgtacaagaccgcggtgaacgaatacatggtgcagcgcgggttcgaagacgaagcgggcaacgagctcaagccgttccatgaccgtgtggtgcgcgccggtgaggaagggtttgcagattccgcacgcgacacgatcatgctcaatgccgacgccgcgttcgccggcatgccgaactgggacagcgcgaacgacgaaggcgaggccggcgggatctcgaaccgccaggcgcgcagaaccggtctcaagcgccaggggcagctcgtggaggagtccgacgacggatggcggcatgcacctgtgcgaccggcaccgcatgtggagttgccgcaatggctcatggaggagccgtacaaggtggcgcaccgcgattacagcaccggtttctactacccggagcagaaggtgacgcagaacaccgatcgcagcgcatacttccgcgattggctcgtggtgggcgaggtgctctcgtggagtcccgaggagggcggtcgcgtgacgatcatgagccgtaacaagatggaaccgggccagctcgtcgagttcctgctgcccgggcgcgcgccgctcgagtacgtcgtaccggacggcggcatacgcgacgccgacggcaacgaggtgccgatggtgaacaatccggcccatgtgttctcgttgccgttgggcgtggaggttccggtgaacgccgcgttgcgctcgcgcacgaagaagccgacgctcaaggcggagtgagcgctgctcgttggccattgtgtgcattgggcgcagattggccgacggacagcgctgcccattggccattttgcgctgcaatgcggaaagaggtcaatgggtggggcaggattgtcgaagatgctttcggtccggctcgtcggtcggtcatttcgtgcaggtgggcacgattcggccggtgaggaacgtgcctcaacgacattttcgagccgaactgtgcaaagtggccgcaggaagacgcgacaggatgtgtgcaaaggggcgcaggatgcttagaccagagctgaaggcgcttgtgcggttggcgttggcggctattgtgtgacgtatgagtgaacaagaacagcatacggatgaacagaacgcgaacgcggcacccaagccgatgcagatcaatctcgatgacctgctcaaggcggtgcaggcgcatgggcagaagaccgtggagcaggaagacaaggccgcacgcgaaggggggaaggacgccgacggcaagacctatgacgatgccattctcgacagctcggccatcgaacccaccgacgacgagggcaacccgattccagtgacgattccggtggtgctctcgcccggcatcaccgtcatttacaccacccgtctgggaggcgtgagcgccgaggaatgggcgcacttcaatcttggaggcaagtccggcgacgaccccgttgctgtggagcgcaaccgcgaggcgcttgccgacgaactccatgtgaagctctcgctcatcgaccaggtgcattcgggcaagtcggtggacatcgacgaggtctataccgagaacaagccgttcggtttcgacgcatccggttcccataccgaggcccaggccaaggcgaagcgtgcgggcgagccggtggtggacgacgttgagtccgagaacgccgaagtgcaggtgatcgagggcgatgcccaggtgacctgccgcaaggacatcgccattggtgtgttcgccgcggactgcctgccggtgctgttcgccgacccgcaggccggggtcgtcgccgccgcacactgtgggcgtaagggcctgcagcgcaatgtgatcgccgccaccgtcgacatgatggtgaagaaaggtgcctccaaggagaacatcgtcgccacgctcggcccggccatctgcggcgattgctacgaggtgggcgaccagatcgccgacgaattcgacgcgcagttcccgggcaccttcacgctgacccgcttcggcggccccggcatcgacctcaacaaggcggcgctgatggagttgcaccaggccgggatcaaggacgaccgcatcttctcctcgcagccgcgcgtcaatgccgccacgcagtacctgtcgcaagacgccgagctcgaggagctgtgccgtgaggacaacgagggagacccggcgcttgaggagcgcatcaagggcattcgctacagcatgtgcacgctggagaacccgctgtggttctcgcatcgccgcgccgaactcgcccacaagaggcatgagggccgcatgctggcgctcattgtgcgttcctgaatgttcatacacagattggatacaacatgactcagcaaaccaaggtccccgtggtcgccgtcgtgctcgccgccggctcgggcgtccgtttcgaccccgcaaagccaaaacagctggtggcattgaacggcaagccgatcgtcgcatggagcatcgaggcattcgagaacgacgagcatgtggacgacatcgttgtcgtggtgaacaacaccgtgcgtgaggccgtcgagcagctcattgacgatgcctcatacgccaaggtgcgcgcgatcatcaccggaggcgccgagcgcagcgattccaccgaggccgcgctcaccacgctcgccgacgccggcattccgcaggatgccaagattctcatccacgacgccgtgcgcccgttcgtctcccgtcaggagatcgacggctgcatcgacgcactcgacgagttcacggcggccaccgtggcctgcccctccaccgacacgattctgctcacacaagacctgggtgaccgcgaggtgatccagtcggtgcccgaacgccgccattcgttccgcgcgcagaccccgcaggccttccgcttcggcacaatccgcgacgcctatgcgaaggcggccggcgacccggatttccggcccaccgacgacacccgcgtggtcgtcgactatctgcccgaccagccggttgcgatcgtcggcggatcgccgcgcaacatgaaggtgaccacgcaggacgacatgccgcttgcccgcgcgctggcgaatgcgcttgccggcgccccgcgcgggccgcagaacgaacggcagcgcgccgccaaggagcagctgcatgccatgttcggcaaggcattcggcgtcgaaggcgagtgacatgcaggaactatcggtggtgatgtcgggcttcgacccgtatgaggatgtgacggcgaatccggcgctgatcgtgccggacacccttgccgaacagggcatgggcggcgcaatggacagtgacgacgacctcaaggacgtcgccatcaccgtgcacgccgtgcacatgccggtcagtttctccaaggcgtggccgattctcgaggccgcgctcgaggagcaccgtccgcagatcgtcgtggcgaccggtctgaagcgggcgtcccgtggcattctgctggaacgctgcgccatcaacgtcaaagacacgaaccggccggacgccgacaacaaggtgccgagccaccatgtgatcaatgcggccggccccgcagcatactggaccgggttgccgttgaacgccatactcggtgcgttcgccgccgacgagattccggcatcgctcagctcgaacgccggcaccttcgtatgcaacgcgctgttctacaagctgcaggactgggcatcgcgccagggtcgcacgctgagcggcttcgtcaatctgccgcccgtggacgagcgcgaacactcgcagcatgggctcacgctcgaccagcagattcgcgccggccgcgacgtgatccgcgagaccgcacgctactatgtcaaaccgatcggcgtgaacacgctcattgcatagtcggcgccctcacctgcagattgccgcatgtctgtggggtaatctgcaaaacatacgctcaatgtgatttttgcggacgtctgcgcgttttccgcggaccgacgcattaaagtgcagttatatatgcgtttgcattcggcaatcggaaaggtttgaacatggtggatcgtttcccggtagttctgcgcggctacgacaaggagcgcgtggacgaggcgatgctggcggcacagaacagcatcgaccgtttgcgcgaacaggtgaaggcaggcgacgacacggtgctgcagctgcaggcgcaactgcaggaggagaagaaccgcaaggcgaacaccgacaactcgtttgcctcgctgggcgccaacgcccagcagatgctcgcctccgccgagcagacgagcaccgagctgctcgaacgtgccaagaaggacgcggcctccgcgcgcacggaagcgcagtcgcaatcccagacgctcgtgaacaacgccaaactcgacgcccagcacctggtcgacgacgcgcaggcgaaggccgacaccattctcaagaacgcgcagagcgaggcgaacaccatcgtgacgaacgcccgtcaggaagccgagcagctgcgcgcctccactgcgaagacggtgagcgaccagcgtcaggcgctcgacctcgagctgacgaactcgcgcgaggagcacaagaagcgcctcgcctccgaacgcgcccagcaggagcgtgagctcgcggatctgagcgcacagaccgccaagacgatctccgagcagcgcaaaagcgcgaacgaggagatggcgcgactcaagagcgagacgaacgaccagattgagaccgcgctcgccgacgccaacaagaaactggccgatgtgcgcgagcaggtgtcgaaactcatgaccgaggcgcagcgcaaggccggcgagatcaccgatgccgccaaggcgcatgcgcaggagatcaccgatgccgccgaggtgaaccgcacgcagacgatgagccaggtgaatgcggaggtggagcagattcgcgccgacatcgccgcccagcaggatgaggcgaccaagaaggtgcaggaactgctgcagagccttgaggaaagccgcaagagcgccaaggaggaggccgagaaggagatcgggcaggccaagcaggcccgcgaggaggccgacgcctacgccgccgagaagcgcgagtcggccgacaccgaggcccgtgagatcgtgcgcaaggccggcgaggaggcctccaagcagatcgaggaccgtcgcaaggcggcgcaatccgagctcgatgggctccgtaagcgcatcggcgaactgcagacccgtgaggcagacatcacgcagcgcgtctccgaactgcgctccatgttcgccaacgcctttgcaggcttcggcttcggcatcgacaagcattcgaccgacacgatgtcggtggtcaacaccgtcgctggcgacaacgactcttcggacactccgcaggccccggccgacaacggcagcgttcgcagcgatctggcgaacaccatgctcatcaatccctccgattcggctcagcatgaggcctcgcacccgatgtcgcacgtcacggtgccggtcgccccggccctccacgatcacgcagcacaggcgaacgcggcggacgacgacaacgccggcacgaacgatgaggcgcaggttccggcggtggacattccagcggatccgaacacgccgtccccggaggcaccggaggctcccgctgcgtcggcagccgaggtgatggaggccattgacggcgacgaaccgatcagtgacgacacccatgtgaccggcgacgcggattcgctgttcgattcgagcgacaacatgccggtggcgccgaacaacgagcagtgacccgcgaaaaccaaacgggcacatcatcatccgattgcatagtcgcgcagagcggccggagtattccggcattcactctgcgcgacttttctcatatgcgagtacagtggcagacagccggtaccaggcaagaagaacaatcacaagcatacgaagcagacgagtggaacagaggagcatatgagcgacaagatcagcccactgagcagccatgatctcgatgatctcaccagcgaattcgaaggcagcaagtccaatgtgatggccatgaacgccgtgaccgcggcaggaatcaacaaggtggcgcgcaactacgaccgtgcccgcctgctgcagcgtcgtttctccacgtcgctcgacaacggcgaggccacccatcaggaccgctcgggccgctgctggctgttcagctcgctcaacgtggcgcgctatgtggccaagaagaccatgaacatcaaggaattcgagttctcgcagaactatgcgatgtacttcgacaagctcgagcgcgtcaactacttcctgcaggacatcgcgaacctgatccgcgagggcgagccgaccgactcgcgtctgttccagcacatgctgcacgatgtgatgggcgacggcggccagtggaccatggccatgaacgtgtacaagaagtacggcgccgtgccgaaggacctgtacccggagaccgaatcgtcgaagaacaccggcgaactcgacacgcagctgcgccgcatgctgcacaccgccgtctcccagatggagaagagcccggagcacatcgacgagatcattctccaggccacgaaggccggccaccgcattctcaccatccacttgggcgagccgccgaagagcttcgactgggagtggaccgacaaggacggcgaattccaccgcgtgggtgagatcacgccggtcgagttctggaaccgctatgtgggcgacgccgatctggagagctacgtctgccttgtcgacgatccgcgccacgagcacgccaagggcaagaagatcggcatcgagcacctcaacaatgtggccggcggcgacccgaccgaatacctcaacgtgccgatccagttcatgaaggactgcgcgcgcgatgtactggtggagcagggcattccggtgtggttcggagccgactgccatccgatgatggaccgtgaggacggcgcctgggccaccgacctgttcgagtacggcaaggtgtatgactacgacttcacgatggacaaggaggagcgtgtgcgcttcgccgactccgcgatgaaccatgcaatggccttcgtgggcgttgacgtggccgatgacaacaagaccacccgccgttggcgcgtggagaactcgtggggcacgaagatcgccgacaagggctacttcacgatgggcgacgactggttcgaccagtacgtgttcgaggtggccgtgcccaaggcgctgctgcccgacgagtacctcaaggccctcgacgagccggcccagatgctgccggcctgggatccgatgggcgccctcgcctaggttctcctttcttccgtcgctgctcggcagcgggacttgacctgaaaggttcaggcatgcccccgcgcgctgcccgtttggcctcgtcgctggatcgcaagcgcccttgacgttcctcagccaaacgggcagcgcgcgggggcatgccgttcgcttcgctcacatggcagcccgactgaaacgttgttgtcccgagcttcccctgggaggaaacggatgcattgatggcgtggcaatgccgagaggggccgatggcggggcgggaggtgtgaggaacgtcaagggcgcttgcgatccagtgacgagcgcctcccgccccgccatcggtccctctcgaagccgttccacccatgaaccgcttcttgccccccatgtgtccattctgcaacatcgctttgcacggtgttgggcaaacgcctaatataaggacagttattcgccggaattggaaggaagaggaaagaggtagcgatggctgcgatgcgagggcccgacagctcacaggattcggtgcttgacgccaatgcggtggtgcccgagaccgtcgatgtgaacattcgtcagctcgatccgattcccgcgccacgctatttcatcaaggagctgccgctcaccgagcagatgggcaagcaggtgctcgagcagcgcgcgcagatccgcgacattctgcatggccgtgacgaccgcatgcttgccattgtggggccctgttcgatccacgacccgaaggccgcacatgaatacgccaccagactggccgagctcgccgatgagctcaaacgcgatctgctcatcgtcatgcgcgtgtacttccagaaaccccgtaccaccattggctggaagggcctgatcaacgatcccgacatcgacggcgagttcgatattcgcaaaggcatgtggctcgcccgcaaggtgctgtgcgatgtggtgggtatggggctgcctgcggccacggaatggctcgacccgatcaccccgcagtacctgtgcgacttggtgagctggggtgcaatcggcgcccgcaacaccgaaagccaggtgcatcgtgaactggccagcggcctgagcatgccgatcggcttcaagaacgcgaccgacggctcggtcaaacccgccgccgactcctgctacacggcggcattcgaacatcatttcctttccatcaacctcgatggccatgtgatcgccgccgagacgaagggcaacccggactgccatctggtgctgcgcggttccaaccacgggccgaactacgatgccgagtcggtggccgcggcattgcgcgacctgcatgaatcgaaggcggaaggccccagcaagcatgggctcatcatcgatgccgcccatggcaactgcggcaagaacgaggtggtcgaggcggccgtcgtcgagaacatagccgaacgcatcgccggtggcgaacgtggaatattgggcatcatgatggaatccttcctcaagggcggtcatcaggcgccggcgccgttggcgcaactcgaatacggacagtcgattacggactcctgtgtgccgtgggctcgtagcgaagaggtgttgcgtaagctcgcccaggccgtgaatgcgcgtcgtgccgcacggtagtatatgtgacagtttccattcacatcgcgcgtgaggcatgcccgcgcgtggggtggggaatcggactcgtgtcatatgagggaatatgcgtaggttctttgctcgtaagggctctacgccggccggtgcgatcgaccgggcggcacagcacgatcacactccccgggcgccgcgtgcggtggagggggaggcttcgaacgcgcctgatcttccagtggccgccggcacaaaagtttcacgcgatgttccacgcggcgttgcgcaggcgcgccatttcaacggcgtggacggcctgcgtgcaatcgccattgtggcgatcatcgcctaccatgcacgcccgatgctgctcaaaggcggttttctgggcgtcacgttattccttgtcgtctccggcttcttcatcacccgttcgctcatgaacgcggtggacggccatcgcttcctgctgttcgactacctgcgcagacgcgtgaagcggctgtggccggcggtgatctcgacgatcggtctgaccgccgtgctcgtctatgcctgcgcgccgccgcttattctgaagatgcgcggcgatgccgtgccgagcgcactgttctatagcaactggtcgttcattttccgcaagctctcgtatttcgatgcggccggcttgccctcgccgctcacgcacctgtggtatacgagcctgatcatgcagttctacctgctgtggccgctcctattcattccgctgttcctgcactgccgcaggcactgggtgcgcgtcggcgtgctgggcgcgctcatcgccgccggcacgctcgagatgatgatgctataccggccagaggccgacacctcgcgtctgtattacggactcgacacccgtgccgccgagattctcgtgggcgtgctgctcgccatgctcgtgcacgacagcgcctcgcgcagtgatcaggaacggcgtgcagccgacgggcgaatcgtgttcgacagacagattggccgatatcacgcggtgctgcggcgtggcgatctgggcgttgtggcagcgggtatctgcgctctggcattggctctcggattcctgctggtggatgcccgtgccgcatggatgtaccacggcggtttcctgttcttcgcggtggtgagtgccgtgctgctgtatgcgagcatgcaggatgcacgggttggccgcatactcggtgtgaaggcgttgcgctacttgggttcgcgttcgttctcgctctatttggtgcactacccgctgctcgaggtgatgaacccggccacgcgcaccaccggcataccctggtatgagtggatagggcagttcctggtgattcttatggcaggcgaggcgttctaccagattgtcgaagcgctgacgggcaccccgtggctgccgtggatgcgttgccgcatcacctccgtgggtgcgggcagattgcgcaccagcgcatggattctgacgatcgttggcgtcgtcatgaccttcgtcatggccctgccgctcgactggcgagccattgcgcacgcgcgctccgtcaaggcgcgtcccgagctcgcgctgaccgccgagcaggcgcgtgaacggctcgcgcagcagcagaagcgcgaatctgaaaccagtaaggagaacggcaaagagcacaaggactcgagcggcaagccgaatgcgcaggccaagcccaaagtggcgccgccggtggtcaaggcgctcaaggtgccggcgaatctggagccgcagcgttgggcgtgcgaccgcaaggcaatggtctgccaggcgaaggtgctcatgatcggcgactcggtgaccgaaggggtttccgacacgcttcgtgagcatttcccgaacgcgacgatcgacggtgcggtgagtcgccaattcgaccaaggcgtgcagatcctgcgtgacgatctcgcacgcggcatggatccgcaggtcatcgtgttcgcactcggcacgaacggtccggtgagcgagcagatggcgcagcaggtgattgacctcgcgggcggcagaccgctgtatttcgcgacgacgcgcgcgccggtcgactgggtgcccggcaacaacgccacgttcatcggcatggcggaacgaaacccgaatgtgggcatcatcgactggtcgggcacgtcacaggggcgcgacgactacctgtacgacgacggcattcaccccaaccaactcggcatgcaggcgtatttgcagatgttcctcaacgcgttctgcgcatgagcgcgcgccgccattcggcacgcccgcgcattccccgcggatttgctatattgtggcacagtgaggaggaacatgagcgagaatccgtacgagccgatgtccaaggagcagaaggacgccatagtgcaagggaacggcctcacctacacgcatgagcagatgcgccaggtgcagcacgccatcgccgcaggcaagaatccgctggtggtgctcgagaatgtgcccagatgggaagacatggccggcgtggaccgcatcatcaaccgacgcgtgctcgaactcgacccgttgcccacaccggcgcaggtgctcgcggaactgccgctcacccggcagatgcaagacatcgtcgcctattcgcgagacgaggtgcgcgcctgcctgtacggccaggacgaccgtctgctggtgatcgtgggcccgtgctcggtacacgacccgaaggccgcgctcgactatgcgcaccgtctgcgcacgctcaaggatgaactcggggaggacctgctcatcgtcatgcgcgtgtacttcgagaaaccgcgcaccacggtgggatggaaggggctgatcaacgaccctgacatcgacggctcgcacaacattcagaaagggctgctgctcgcccgacgcaccttgctcgatgtgcttggcgcgggcgtggccacggccaccgagttcctcgaaccgaccagtccgcagtatatcgccgacgcggtcagctggggagccataggcgcgcgcaacacggaaagccaggtgcaccgccagctggccagcggcatgagcatgccgatcggcttcaagaacgcgaccgacggctcggtgaaagccgccgtcaacagttgcattgcagccgaggaccagcacacgttcttcggcatcgaccaccgcgggcgagcctgcgccgtcgagaccctcggcaatccggactgccatgtggtgctgcgcggttccagctccggcccgaactacgacgccgaatcggtggcgcaggcgctcgcctccattcgcgacaagatgggcgacgaggcggccgcctcgcatgggctcgtcatcgactgctcgcatggcaactccggcaaggacgacgtgcggcaggcgcaggtggtgcgcgagatcgccgaacgcatcgcaggcggcgagcggggcatcagcggtgtgatgatggagagtttcatcgtggggggcaatcaggcgccggcaccgctcgccgaactcacctatggccagtcgatcaccgacaagtgcctgagctggccggtcaccgacgagctgctgcacacgctcgccgatgccgtgcgcacccgccgctggaaccgctgacgcagccgcccgcgttccaaccgcggagtatattcgggtgatatcgattgccgtatgcgcttgcagcgaaggagaaccatgcagaccgtcgccatcatttccgccctcgacgaggaagccgcacatatcgcggactcgcttgacaacatgaccgtgaccgagcgtgcgagcctcagtgtcgcccggggcacgttgacgaccgatgcgggggaggaactcgacgtcgccgtgaccgtgggcggcatgggtttggtgaacgcggccgccaccacgcagttcctcattgacctggtgcatcccgaggccgtgatcttctccggcatcgccggcaacctcaacaagagcctgcacatcaacgacattgtgctcggcaagacgctgcgctacctcgacaccgacatgcgcctggtgggccagtggaagccgggcaccagcgagttccattccgacccggcactgcttcagatcgccgagggcgcccttgacgagatgggcatcaaccacatccagggcaccatcgcctccggcaactactttgtcgacacgccgcagaaggtgagccaggtcatcgaacagacgcatgcggacgccgtcgagatggaaggcgcggccgttgcccatgtggccgcgcgcaacgacgtgccggcgctcgtcatccgcgccatgagtgactctgccgacaccgactacgaggagttcaaggacttcgacatctccgaatacgccgatacggcggcccgtctcgttgtgcggattctgcgcgggatgtgaatggggcaccggttcgcgatggaagggcgtcatgacaccaggtgagattgccatggcgattgccatgggcgtgctgctcatagctgggggctatgccatcgcctaccgtgccggtcgcaaccgggagcgcgagcgggagcccagtgaggccgcgttgttcgccgggcatgccgatgccgatgccgtggatggcgaacgccgcatgcttgcgatgctcgaggaggccgtcatcgtcaccgattccagcgccaatgtgctcgtcgcgaatgaggcggccattgaacgtggcctgagcgtggacggtctgatcgtggacgccggcattcgcgatctcgtgcaggaggcggcgcaatccgacgcggcggtggaacgggagctcgaactcgcccgagattcgcagcggctgcatgtggccgtgaccgcgcagtgcacggccgacgatcgggtgacggtggtctgtgccgacaccgggtaccgacgcagcgtggaccgcgtacggcgtgatttcgtgaccaatgtgtcgcatgagctcaaaacgccggtcggcgcgatcatgctgctggccgagacgattgacgatgccggcgacgacgtcgacatgatccgccatttcgccgcgagaatcggtgtcgaggcgaaacggctcgacggcctcgtgcgcagactcatcgaactcggccgcatgcacggcgatcgggccacgacgcgacgcacggtggatgcgcgggaactcgtacggcaggcgatcatcgacaccgaggtcaccgcaggggcacgccataccatggtgcgcatgcgcgatgacgccggcgagaatcatccgctgccggtgacggtcgatgcggcggcggtgcatatcgcgctcaagaacctcgtggagaatgcgatcaactactcacccgaacatgccgaggtcactgtggaggtctcccgcggggaagaccaggctcgcattcgcgtcgtcgatcacggcatcggcataccccggcaactgcagggccgcattttcgaacggttctaccgggtggacccggcgcgctcgcggctgacgggcggcaccgggcttggtctgtcaatagccagccatcacattctggccaatcagggcaaactcgaggtatggtcgaaaccaggggaggggtccacattcacggtaatgttgccgttggcgatgcgagacgatgacaccccatgcaatcgggatgcggatgccgagggcgatccggacggaacaggcaaggaggccgacagatgacgcgcattctcgtggtggaagacgaaccttcctacctcgacccattgctctaccagctcacccgtgaggggtacgaggcccatggagccgccaccggggaggaggcgtgggagctgtatgaggagatggagttcgacctcgtgttgctcgacctcatgctgcccggcatctcaggcaccacactctgcaggcgcatgcacgagctgcgccgtgtgccgatcatcatggtgacagcgaaatcaaccgagaatgatgtgatcgtagggctcgaaatcggtgccgacgactatgtgaccaaaccgtactccttccgcgaactgctcgccaggatccatgcggtgttgcgtcgcagtctcgagccacgggcttctggaacacccggagggaacgatgagacgcttacatgcgggcccatcgagatgtcggtggcctcgcacgaagtgcgcattcacggtgaactgacccagttcccgctcaaggaattcgaggtgctcgaatacctgatgcgcaataagggccgcgtgctcaccagacagcagctgatcggccgcgtctggggcagcgattacgtgggtgacacgaaaacgctcgacgtgcatgtcaagcgcatccgggcgaagatcgaggccgatccgtcgaatccggcactgctgacgacggtgcgcggtctcgggtacagaatctgcgacgaacgttcacgctaaattcaccgttcgcctcaatacgactccccaccctcctctacactgaattggttggatacaatggcatcgtgaccaaaggaaaccacatgcgtagcaatcttgcacggcgcgtgctcgcggcactgtgcggcatggcgttcattgccacgaccacggcgtgcggagacaacaccgatccggcgaatcgcccggtcgccaacgcctcgtcgatctcaggcagtttcgcaggagcaggggcctcctcgcagcaaacggcggtcgaggcatgggtggccggctaccagaagacgaatccggatgcgcgaatctcctacaatccgtcgggctcaggtgccggcgtggccacattcctcaccggggcgaccgtatgggccgcctctgacaagccactggatgccaaacaggtcgaggagtcgacatcggtatgcgccggcgcaagcgcgttcgacgtgccggtgtacatctcgccgctcgccatcgtgttcaatctgcagggcgtctccgatgccggcaaacacatcaacatggatgcggccaccatcgcgaaggtgttcgacggcagaatcacacggtggaacgatgccgagctcacggcgcagaaccccggactcagccttcccgatctgccgatcaccgtcgtgcatcgctccgacaaatcgggcaccacgctcaatttcctcgaatacatcaaggcggctgcgccggccgattggccgtacgagctttcggagaactggcccaacgacgtcgggcaaggcgccaaaggcacctcgggtgtgatcagcaccatcgaccaggcgaacggcaccatcggctatgcggacttctcccaggcgggaggcatgggaaccgtcgcggtgcaggtgggcgacacccctaccgtgatctcggccgaggccgcctcgaaggcagtcgccgactccacactcgacaaatccgttcctggcaaacaccgtgtggtgctcgacatcaaccatacgacccgcgtgacgggcgcctacccgatcgtgctggtctcgtacgacatcgcatgccccgcctacacggatgcgaacacggcgcgattcgccaaatcctggctgagctacgtcaccagcgaggaagggcaggcgcaggcgatgaacgcgaccggatccgcgccattgcccgccaacatcgccaaatacgtgcgtgaatccatagacgccatggaagtgaagtgagcatatgtcatcggcaccgaaaccacccgcacagccagccgcagactcgtcgctgacgaaaccggtcagcggcgagaaagccgaccgcatcttccgcggcatcgcctacgcatgcggcatactcatcctcgtcgtgctcgccgcagtcgcgctgttcctgctgttccgcgcatggccgctcatcggcggagaccagcggacgaacagcgacgtcatctcgagtttcaccggcggcaaggcgacgagcttctggggctacgtcggcccgctgctgttcggcaccgtgctcgtggcggcgctcgcgctcatcatcgcgttcttcgtctcgataggcatcgcgctgttcatctcgcactatgcgcccaaacgcctcgcggccatgctcagctacatcgtcgacattctcgcggcgatcccgtccgtcatctacggcctgtggggcggccttgtgctcgtcccggcaatctatccgttctggaactggatcgccgagcatctcggatggatccccatcttcgcaggcccggcctcgaacccgccgcgcaccgtggcgacggtggcactcgtgctcgccatcatgatcctgccgatcatcacgtcgatcacgcgcgacatcttcctgcagacccccaagctgcttgaggaggccgccctcggccttggcgccaccaagtgggagatgattaagatgtcggtgctgccattcgcccgctcgggcatcatctcggcgtcgatgctcggccttggtcgtgcgctcggcgagacgatggccgtgctcatgatcctctcgccgggcctcaaatactcgttcaaactgctgcaggcctcgcagaaccagacaatcgccgcgaacatcgccgcgcaataccccgaggccgatagcatcggcgtctccgtgctcatcggcacaggtctcgtgctgttcgtgatcacgttcctcgtgaatctgctggcacgccgcatcaccgagaaagcgagcaaatgatgagtgaaccgcagtccacgccgcacgccgatgcggcaccggtgatcgacttcgacaaattcaagccgacgcgttcgtacaccgccgcgcgcaaacgcaaggacatggtgatgcgcgcgctcatcatcctcgcgttcgtcgtcgcgctcatcccgctcatctctgtgctgtggacgacattggcgcatggcatacgccgactcaactgggatttcctcagccacaacatgacgaacgtgatcggcggcaaccagacgccgtcgggcggctacggcggcatcctccatgcgatcatcggcacgttggagatcacgctgggcgcgatggtcatctcgatcccgatcggcgtgatgtgcgcggtctacttgattgaatacgcgggcaaatccaagctcgcgcgcacgatccacctgctcgtcgacgtgatgagtggcatcccgtccatcgtggccggcctgttcgcctactccatgttcgcgatcctcgtcggtcccggcacgctcaacggtttcgaaggctcggtggcgttgtcgctgctcatgatcccgaccgtggtgaagacgacagaggagatgctcaagatcgtccccaacgacctgcgggaggcatcgctggcgctcggcgtgaccaagcagcgcacgatcacgaaggtcgtgctgcgcaccgccctttccggcatcgtgtcgggttccatcctcgccatcgcccgcgtgatcggcgagacggctccgctgctcatgaccgccggctacatcgtctcgacgaacgcgaatctgttcttgggtgaaatgaccacgttgccggtgtacgtctatcaggagtattcgaagtaccatgcgaactgcccggccgacgccggcagcggctgcgtcaccgccataccgatggagcgtgcgtggtcggccgcgctcgtgctcatcgtcatcgtgctcatcctcaacctcatcggacggatcgtcgcgaaggtgttcgcgccgaagaagaaatagcacgccaacaccatcacacctagataaggaatacgaatgggacaacaaatcgacattcgccatctcaacatctattacggcagtttccttgcggtcgaggatgtcaatctgcatatcgccgcgaacaaggtgaccgcgttcatcgggccgtccggctgcggcaaatccaccgtgctgcgcacgctcgaccgcatgcacgagatcacgccgggcgcccacgtgaaaggcgacgtgctgctcgagggcaagaacctttatgcaaaggatgtggatccggtggccgtgcggcgtgacgtgggcatggtgttccagcggccgaatccgttccccaccatgtcgatccgtgagaacgtgctcgcgggggtgtcgctcaacaaccgcaagatctcgaagtcggatgccgatgacctcgtggagtgggcgttgcgcggcgcgaatctgtggaacgaggtcaaggatcgcctcgacaaccccggcatcgggctctccggtggccagcagcagcgcctgtgcatcgctcgcgccgtggccgtgcatccgcaggtgctgttgatggacgagccatgctcggcgctcgacccgatctccacgctcgctgtcgaagatctcatcgaggagctcaagcaggactacacgatcgtcatcgtcacgcacaacatgcagcaggccgcccgcatcgcggactatacggcgttcttcaacctcaaggccgtggggcagcccgggcacctggagtatttcgccgatacgtcgacgatgttcaacaacccgcagaacgaggaggccgagcgctacgtttcgggccgcttcggctgagagagaggtttgttcctgtgccgtggggctgggcggatgcggggcatcttgctgaggaacgccacggaacgcggacaaccgacgaagcgggagacctgcggccgactgggggcatatccgtggcataacgcgcccatgtaacgaccgtgttttacacacccgtgctagtttttagctgtcctgtcgtttgcggcggggcggcagaaaagagttcacgagaagaatacagggttactcatggagaagtttttccatttgaaggaaaacggaacgtcggtttccactgaggtcatggcaggcctcacgacgttcttcgcaatgtcttacatcatcgtcgtcaatccgcagatcctgtcgcagacgggtatgccgtggggcggcgtcttcctggcgactatcatcgcagccatcatcggcacgctcgtcatgggcctgttcgcgaacgtcccgtacgcgcaggctcctggcatgggcctcaatgccttcttcacctacaccgtgtgcttcggtctgggcttcacctggcaggaaacgcttgccatggtgttcctgtgcggtctgatcaacattctgatcaccgtgaccaaggtgcgcaagatgatcatcaaggccatccccgaaccgctccagcaggcgatcggcggcggcatcggcctgttcgtcgcctacgtgggcctgctcaacgtcaacttcatcaccttcaccccgaaagacacgaaggcagccgggcagggcctcgcaaccggcgccaccccgggcatggccacgctcaacagcccggtgctgtggctgttcctcatcggcctgctgctcgccatcgtgttcacgatcctcaaggtcaagggcggcctgctgctcacaatcatcatcaccgccgtcatcggcatcccgatgggtctgaccaccatgagcaactccgtttcgctcggcgagaccttctcgcagctgccgcagaccttcggcgccctgttcaccggcgagggcttcggctcgctgttctccgacccggccaagctcccgctcgtgctggtgacgatcttcgcgttctcgatgtccgacaccttcgacacgctgggcaccttcatcggcaccggtcgtcgcaccggcatcttctcgaaggccgatgaggagtcgctcgagaacggccatggcttctcgtcgaagatggacaaggccctgttcgcagattccatcgccacctcgatcggcgcgatctgcggcacgtcgaacaccaccacctacgtcgaatcctcggcgggcatcgccgccggcggccgcaccggcctgacctccgtcatcgtcgctgcctgcttcgccgtctccgcgttcttcgcgccggtcatctccgccgtgccgagcgctgcgaccgcgggtgtgctcgtgatcgtcggctgcctcatggccgcctcgctcaaggaagtcaagtgggacgacatcaccgaggcaatcccggcgttcttcgccgccgtgttcatggcgttctcctactcgatctcctacggcatcgctggcggcttcatcacctactgcatcgtcaaggtgtgcaagaagaaggccaacgaggtgcatccgatcgtgtggatcgtctccgcgctgttcattctcgacttcatctgcatggccgtgctctgacggccgcagcggaatcgcatcaaataaggccccggctatccggggccttatcgtatgttgtgagccgcttgccgccagacaatctgctgagttgtctgcgtacttggtttgtctcagggtgagcggctgggtgagacaaaccaagtcatgagaaccgggtttgtctcacctagagcgcgtcagcgagacgaaccaagtcgcaggaacttagtttgtctcatatggagcgtctcagtgagacgaatccggtcatgacaacttgattcatctcattgagggtagattggcgagacaatccaccccactgcagctgcatttgtctcgctcgcgccgattacttcttcttctgcgtggcctgaatctgctcggcgatcgccttcagccactcgttgagcgtcttgtactggcttggcatctgttcggtgatgtcgaccactgggatgttgcccgagtccgccgcgtccgtcagctggtcgctcagctgggacttctcctgcgaatttgcgatcagcatcttcatgtcgcccttcttgagcgcctcggtgaagctcttgatgtcggacgccgtgggctcgctctcgttgctcgtcgcgttcttgtatcccttcggcgtgacgtcggtcatgcccatgtcctgcgcgaggtagtcgcccaccgactctatggcgccgtacggcatcttgccgtcggcctgcgcgacggtctgaagctgcgcttcgagatcgtcctcctcggtatgccaatccttgttgagcttctcgaattccgccttctcgcttggcatgagtttgatgtaggcggcggtgatctcatccgccgtcttgttgcgtacggcggcggagaaccacacatgcggattgtcgccggtcttcttgcctcccgcggcggccgcgtcgatcacgatcgctttggactggccggccgccttcgccgcccactcgtcgtagccagcgccgttgagtatcgcgacctgcgcatgctggaacttggagatgtcgttggtcgaaggctcgtaatcgtgcgcatcggtgccggtgttgttgagaatgctggtgacgtccacataccggccgccgagttgcttggccacggatccccacacgttcgtcgaggcgatcaccgtgatcaccttctccttgtcaatctgggtatctccggcctttgagttcgagcagccggccaccgcgaatattgtggccaatgcggcgagcagaatcgtgagtgtgcgcaacagtctcttcatatattcattctccattccggggtttcttcgagtctaacggcatatgcaatgccgctgtatctgtttgcagattagcagaaagtgagaatcgttctcaatagcagtgttgcgacacgccgatgttcacgaaatccgcccatatggttcatttgtcgagatgactgtgtaccttaattcccgtaaaccacagaccgttggttgagccgtgcgagcggttcaataatttggttcaagccaacgcaggttgagaaacatactcccgtcaccgggaagccgattgcggctggatgatgctctgcctgtgtgcagggcaatttttttgcccgcgcttgttccgaagtcaacggccgacttaggaaggaacgccatgaagaggcccgaaaaggaagcggtggttgccgagcttacggaacagttccgtaacgccagcgcagtctacctgaccgagtaccgcgggcttaccgttccgcagatctccgatctgcgcgaaaagctaggccgcgatacttcctataccgtggcaaagaacacgctgttccgcatcgctgccaaggaagctggcattgagggtctcgacgagatgctcaagggtccttccgccgttgtcttcgtcgatggagacttcattgaggccgcgaaggtgctgcgtgacttcgccaagaccaacaaggctctgatcgtcaagggcggtttcgcagacggaaccgtgtacgacgcagaaggcgccaagcagctcgcagacctcaagtctcgtccggaactgcttgccgaactcgccggcgcgctcaagggcaccatgtccaaggccgcctacctgttcaacgcgctgcccacgaaggtcgttcgcacgatcgacgccctgcgcgacaagcaggagaaggctgcctgagacccatcgcctcgcggcgtgagtcttgtattttccggaaaacaacaaaatttgaggtgttggccacaacccaataatccggtcaacgccatgattgaaaggaagccataatggctaagttcacccaggatgaactcctcgaagctttcggcgagatgaccctcgttgagctgtccgacttcgtcaaggccttcgaagagaagttcgacgtcgaagccgccgctccggtcgccgctgtcgccgccgccgctccgggcgctgccccggccgaggaagagaaggatgagttcaccgtcgtcctctccgccgttggtgacaagaagatccaggtcatcaaggctgttcgcgccatcaccaacctcggtctggccgaggccaaggccctcgtcgacggcgctccgaagccggttctcgagaacgccaagaaggaagacgccgagaaggccaaggctcagctcgaagaggctggcgccaccgtcgaactcaagtgatccgtgcggcttggccgcatgacaccgcgttcgcagctcaggctgcaagaggctcccgcatcgatatgcgggggcctcttttcttaccctgtagcgagaaaagctcgctcaatcgctccggtcgcacggttttgttcacttgattggtagaattgctacagacaagaggcgagcgcgaatcgcagatgccaatacgacggcgaacgcaggaaagggtggccaacggtgagcagcgagcagggtgctacaaccaggtgggtgattcttgtagacggcacacaattggcgagtgtggagcccggcacaaccgtggagatcggccgcaagccattgcgacccttgccggacgacggcaagagacgcgtcgagattctcgacgactcccgctccgtgtcgaaaaggcatgcccagcttatggtggcgctcgatggccgtgcctttctgcgtgacctgaactccacgaacggaaccttcgtggtgcgtgctggcgacgagctcgtgcggctgcagagtggagtcgattatccgctgcagtcggattccgtacacgtgcagttcggcgacgtgcccgtggatttcaccaagttcattgaagacgacgattccacgaaagacgacgcaccggtggtcaatctgttcgactatgcagtggagggttcgtcgaacgagcccgaggcggcagacatgtcggtggacgacattctcaatctgcgtgccggagagcccaccgacattttcaatgcgagcatggtgcgcgcgcgtgccaagcgcatgcatgacgccgaacagcagtcgttcgtgccgttcacgcagccgatcaacccgttgccgatgcaggatctcgacgacagtgatgccggtgatgccgcgccgcgcgatctgttcgccgatgccaaggacgtggccgaaggcaagatctcggaaccggcggcggcccaggagcacccatacattccgaagatgtccgacaagccgaagcatgccggcgcgcctgccgaccgtctgatcagcgtgagcgaactcgcctcggcgcatccgcgaagcatgccacagcctcaggagaacatgccggagcctgctgcggaagtagacgccgcatccgagtcgatcgtggtggagcagacctccgtcacggaggagacgacacaggaagaacctgccgagccggtcgccgcagagcccgctgcgcagggcattggcgagcacggcgagagcgtgcagccatctgcgaatgcacccgctgttgaggagccggacgggaatgcggaggaatccgcggcagccagcgagcaggcgcccgtaagcgacgaggaatcgcgccagaatgaggaaccctccggatctgcgggcaccacctccgacgaagctgcgtcggaaacggaagtgaacggcgacatcgcgtcactcgccgcgcaggatgtgtcgcaggacgaacaggaattgcgcggcgacaacgcacccgaggtggcgacggtgacggtggatgccgcggacgtggactactcccggttccaacggcatgacgagccgcagacggacgagtctgcagagggggaatacgagccggcgttcgaacccggatcggtgttcgagaaggtggcgaacggcgatttcgccaagtcggagccgctggtctcggtggcagggttcacctcggacgacgcgcggcgcagcgacgacttctcggagcagttcgaaatggcacggcacccggaactgctgccgttcctggccatgaacccgtcgctgtacgacgatctgtacacatggctcgccgcacagggcaatgcggatattgacgaggcgctcagcaagaacgcaggatacgaagactatcgcaaggcaatggggaagtgagctcgatgtcgaacaccgatacaccagaaacgaaggcccctacgagcggttccatagacaagttgcgccgctggcgtgacgaatacagggcgagcctcatggcctcgccgttggaggatgtgaaccagctgagcgccaagctcgacctgacccatgcgcacccctcgggcatctcacagctgttcgccagcggaagtgccccgttgcattcgctgttccgcgacagcggcatgctgcgcgcggcggcacggcgtaccgagcgtgtgctcgacgaccaaagcgccaagaagcgcatcagcggcgttgccgagctctccctggtggtgggcgtggccacgtggaagggcaacaagatgccggtgctgctctacccagtcgaggtggtgcgtgacggcactcccgtggagaaccatacgacgatcaccttcaccggtcatgtgcgcctgaactcggccttcctcaatgccatgcgcgagaacggtgtgaatctcgacgagcgcgcgctgttcgatggctcgaactatgccagcggcacgccggagacggctgcagtattcgcggtcatcacgaaggcggcgcaacaggtgttcgccgacttctcaatcgaacggcagatcattctcggctgcttcgtcgacccatccacacagatcctcatggaaagccgcatgatcatcgagcggctggcacgtggtccgatcaacaatgtcatgctcaatgccctggccggctacccggaagccatcgagcaactttcgcggatcacccttccaccgtatagccccttcgacggcgacccccactccgaatacgaggtgggcgatgtcgacaacaccgtgcgttatgccgccaacgtggcggccgccggccattcgctgttcgtcgacggcacattgggcaacgacaccgccgagcaggccgcgtcgatcgcctcccgttgcatcatggccggccggtccgtgctctacgtgccatgcgtcacctcgcagaagcgcacattcgccatgctcatgaaggccaacgaattgggcgagcaattgctcgacgtggccaacccgaacgccaatgcggccatcgaccaccagctcatcagcgcggtgggataccagcagggcgtcgccacctcgcgtttcgaacagctcgccgatgaactcgtgggcgtccgatcccgcctcacccgctatctgggagacctgcacggcgtgaatcagacgtggggcgtctccgcataccagacgattcagaacctcgccagcatctccgaattgccggcgcacccgatgacccgcgtacgcctcacgaaggaatgcgcgctcgccataggcaaatcgctggatgagtgggccaagaagctcgaacgtgccggcgaactcggcgaatactcggtggggcccgatgacaccgcatggtacggtgcgtcgctctacagcgaggaggaggccatcgacgcctaccaacgcgtggtgaacgtgctgcgatccctgctgccggccacgcgtgaacaggtcaccaccaccgtgaaggtgtgcggcttctcgattccgcaaaccgccgatgagtggagcaagcaggtcaccgtgctcaagaacctgcgccgtgtgctcgacgtgttccagcctgagatattcgagcgtgacatcgatgcgatgatcgaggctacggagtcgaagcaggagcgcaagacgagcgattcgcagatgggcttctgggatcgtcgcaggcacatcaaggaagccaagagcatgctgcgcgtgggcgcccaggtggaggacctgcacgaggcattgctggtggtgaagcgtcagggcgagcagtggcgtctgttcgtgccgcatggcggctggccggtgctgccgccgaagctcgacgacatcatcgccacccaggaacagctcatgagcaatctaacggcccttgacaccgtgctggccaccacgccggccggggcggagctccagcagcaggacttcaacgcactggaggaacgtctcaaggccctattcgacgaccgcaaggctctcgacaccctgccggaacgttgcgtgatcgaacgcgagctcaagcgcgccggtctcggtgagctggtggacgacctacgtgaacgcaaggtcaaggtggacgccgtgagcaacgagctcagactggcatggtggaccaccgtgttcgacgacatcgtgcattcctcggccatcatttcgaaccaggacggctcggcattgcaggcggcctccgaccgcttcgtgcaggtggatgtggagcatgtgcgctccattggccccatgatcatgcaggaatcgatgcgcaggctgtgcgacctgctgttctcccgcacgcaggaggccaacatgatgcacacggccctcgctggtgcgtcgagcatttcgttgagccgcatccatcaggaccatccggagattctcgctgccgccaaaccggtgatcatggccacgccggccacgctcgctgccgtgacaaatccgacgcccattgccgacgtcgtgatcatcgatgccgcggcacacctgccgtcggtgctgctgctcagcattctgtgccgtgcacgtcaggtggtcatcctcgcgcatcgcagcacggtgaccagtgagggcatcggcatgctcatgtcaatgctgccgaacatctcggtagcctctcaccccactcgccgtgatccgcgcgtgaatcgtttcctcgaggaacagggctacggcaaggtgaacaccgatgtcgtgcgtgaaccgatgcagggccatatacgcttccacaagatcgaggccgcgggcgtaccgctcatggccagcggactcgtggaaagcagccagcaggagattgccgaagtggtgcgcctcatcacccagcgcgcgcagaccttcaccctcgtgcctccgagctatttgctcaccgtcgtgtgcctcacctccacgttccgcacccgcttgggagccgaactgcgctccctggcggcgaagagcgaggcgatgggtcgattcctgcgccatgtgcgcatcgtcgacatcgccgatgtggccggcgcccgcgccaccgacgtgatcctgtcgatgagctatgccaagaccactcatggtcgcctgctccagcagtttggcgtgctcgagaacaacggcggccgtggcatgctgctcgatgcactcgcattgtgcgatcaccatctcgacattgtcagtgccttcggagccagtgacctcgacgacgatcgtctgcatcaggacggccccaagatgctcaaggtgctgctgcagtgggccgaggacctcgacgaggccaatgtggtgcgtccggcgattaagcaaaccgacgagaacgtgctgttcaacgatctcgcgacccgcattcgggaacgcggtctcaatgtggctgtcgactatggctatgatggcggcatgaagctgcccatggtcgttggtctcaaagacaagccgttcgcgctggctgtattcaccgacgacgcccagttcatgggcatgcagtccactcgggagcgtcaccgcattctgccgcaggagatcgaaagcctcggctggtccgtcatgaccatatggagcgtcggcgcctttgtgaaccccgagaaggaagtggaccgtgtggtcgcacgtctcggcgagatttaccaggacaagcagtgacttcgatcggcgacaactaccgagtaggcaggctatgaccaacaagaacgaggaaccgacctcatcccacgatgccgcgcgtccgtatagcgccacgcgccgtacaccccgcgtgcaccggcgcgtcgtgcatcagggcaccgagcggttcgacgccgacggtgtgaagccggaaccttccgagatgcagacggcacagcaacgccaagctgatgacgataagcgcattctcggcgaactgcccccgcattgggctgtattcgaggaacgccaatagcggctgggcgtatggccctcatgacgcacctcgtgccgcaatcaatgtgccatgctcctgtgcggcaagcacctgcaacgcctccacggcgctcatcgccatctgcgtcactgtcgagccggtgtcgtcgagtctcggttgtgccattaccaccgcgtgactgctcactacgcacccttctggcgaggcgcgggcatcgtcggcgcatgcctgtgtcgaacgcagttccaccacggtgccaatagggaaggaatgctgcccgagtccaagtcgcacatcgatcacggtatggtgctcgggaacttggggaagctcaccgacatcggtggtcagtagaatatcgcccttctcgatgcgggtctgcgtgaccagccccactgcgtcgtccgggcaccccagtgcatggcgcagggcgtcatggtcgggcatctccaccatctccacatcgccggttgcaatcaccagaccggcatcgagatcgcgcgcggcgaccacggcctgccgtgtggccgtcgccagtgccacgcattgcagtgtgcagaacaacgccacgcctacagacagcgccagcagcatgtggcgaagctgccacagcagtctgcgagtctgtaacgacacgccatgccttctgtcttcggtttcggacgaaggcaggaatctgcgagcgaatcgtataagaaaagccatcatggttccatgatggcttggtgggatgcgcgaatccagcgtgacgggtgattgtggttaattaacggcgttacttaatatacagcgttactaatctacaatgggtcgacctgtaaagggcatcgcgtcacttcgacgagctatggctgtcggtccggtagaacccgctgcctttgaacgtgatcggcacagcggcatacactttatgcacctgctcggcgccgcactgcgggcataccttgatcggatcgtcgctgaacgactgctccttcgtgaagtcatacccgcacttcttgcagcggtagtgatagataggcattccagactccttaccccaaacgaataccggtctcgctcagacatatcctaatacgggagccgacacaatggccgcatgcacccggcgcgcgcaacgggaattcccctccgacaacagcagtgcgggccatcttattcgtcaggttcaccggcaggggagtcgcacgaagggtcgtcggtgtgagcgcgggttgggccagtcgagcccaatcgtgtgaatccacggggcgtgagcacggcattcatgcgcacatcgtgctcctcgcaaggcaatggggcgtccacgaactcccatggccagcacatggccatcagatcagcctgcggacccgcgaaccggagcgcacggtcataccaggcggcgccgcgccccaaacgcacgccggccggattgacgagcaacgcgggaacaatcaccgtggaacacatctggagcgcctccggcgggtacgtctggccttccggttcgcccgggcgacgcgtttgcgcatgcggaaacagcgacggctccatctgatcgacggcgacctcatcaggcacatgcaggcgcagcagatcgtcgagggagcgcagcacaccccagcccagatcgagatcgacgcccattttcggcaccagcaccgtgtagccacaaccgagcgcgattgacagcagtggaatcgtgctgatttcagtgcccatggagacatggcaggcaatgatgcgcgaaggtgattggaataggccggcctcgcaggcgatctgcgcacattgctcgcccgcctgcatgctcatgctgagcgacgtgccacgccttcgcacgaacacctcatggcgcagcatgcgtttcgcctcggccacgttcgtgaattgcgcacccccatgcggcattgcgtcgatttccacggcaaccccctgtgaaaccctgacttcctgtgacttatagtagcggaaaactactatgcggatggctgccgtctcaaaatatatagacagaacggtatcgcatgtcggcgtaagaagctgacggcgtggcacaatgttggtatgtcggtattccaagccttgcatgatgtgatgaaacgccgcaggaacagcgccttcacggcgccattgacgctcaaatcccctgccggttcgcccgacctcacgctgaggacgatggacgcggcggatcaggaggagtggggtcgcctgcgcagtgtgaacgagcggtggctggcgccatgggaatcgtcggacccgcacggcaccgagccgctcaccttcaaatcgtgggtcaacaggcagcgtgaggaggagcgtgaaggcacgtcgatcatcttcctgatggaacatgaaggtgaaattgttgggcagatttcgctcggtgcgatttaccccggacctatgcgcaccggaatcatcggctactggatcgacgaggatcatgccgggcggggacttacgccgctcgccgtggccatgctcgccgactgggcgttgctggacccgacgggaccgcagctgcaccgtctggaaatagatatagtgccggaaaatgagcgttcccgccgcgtggtgcagaaggtcggggcgaagtacgaaggcgtgcgccgtcaatatatgtatgtgcatggggagtggcgcgaccacgagtcgtacagtctgctggacaccgatgtgccacaggggttcgtgcatcgtcttttaggcgacacgcccggagaatcgctacacaacttgtcataagttcttctattcttaggaactatggattacgagtcgctcagcaccattgttctggtggtgatcgtcgccatcctcatggtgtcttggctgcccagacggacggttcaaggcatgaagcaggtgatcaaacaccagtccgaccggtactcggcctcgcttcatctcatagatgagggcgatggcaccagattctcggatgcgcggactgtcgagctgaaagggacgcccatggcttcgccacacactgtgcgggaccgcgaatatgtggcacaggtgcgcgatctacgtcgcgctgcagcacgccgacgcaagattctcgtcggggcgttgctgggcatctcggtgctcgtgtttgtgctcgcggtgattctcgtcttcagcccatacttcactctcatacctattgcactcatgtgcgtggtgctcgcactgggggcgcatgcctcccgacaggcccgcgaatgggaggacagacacgcgcagcggcagcgtgaactcaaggaacgcaaggtgcgtgagaacaagcgtgtcgtggaggagcgcacgcgtgcggcacatcctgagccttcggcccgcaggcagatgcaagacggttcgcagaccgacgtcatggaggcacgtgagattcaccaggccttgcagcgcgcccgcgaggagcaggcacgggcgattgcgcgacgcaaggcgcaggatactcgtgaccatcatgcggatgaggcgtcactgcgctccggcatgcgtgcggaacatgccgacgtcgatgccgcggtgcaggccgccgaagaggccactcataatccagggcatctgacgattcgcgaggagcgtgcagcgcagatgagcgatgagacgaacgagctcgcgcagatcaatgcgtcgtcggcaccggatgccttcgacatggcggtgaatcaggacctcatctcgttctcgcttggttccgatccgttcgacgggccggaagtcgttcagagcatggaaatcaagtcgacccgtcaggtctccaaggccgtgccgaaggacagctcatcggccaagccggcggatgccggcgctgcggaatctcgggatgccgcagccgacaacgccgacgtaaaggaggcgcagaccgtctccgccgtctcggtgaacgactcggtcgccttccacaacagcgaggcgcaggcgaatgtggaggccccggatgcgtcctccgattcgctcggtgtggatttgcaatccattcttgccagacgcggcaactgaaacgccaaacctgaattgcaaagccggccggaaggtcggctttcgtgttcctgggacattggcgtcagctgttctctcaaagcgttagcactcgagttggcagagtgctaacgaacgcgctactatgtgtgagtagcgcaaaggagtgtgcaacggtgttcgtcagccgccgccgcatgttctggcgcggaaatactgaactctagaaagagaggcgcgcagtgtcgttcccactcacaccgttggaagacaaaatcatcgtcaagcaggcggaggccgagacccagaccgcatcggggctgatcattccggacaacgccaaggagaagccgcagcagggtgaagtcctcgccgttggcccaggtcgtcgcgacgacgagggcaagcgtgttcccatggacgtcaaggtcggtgacaaggtgctgtactcgaagtacggcggcaccgaagtccacttcaagggcgaggaatacctcatcgtctccgctcgcgatttgctcgcggtggtcaacgactgaactagttcgagctagtcctgcctttcgaagccggtccgttgcgggccggcttttcgtttgtctggcgtctctgttggcctttccgtgtcactgtgcgcaatgtggacaatgaaggatgccgcacactggctgtttcgtgcctgcgtgcacgatatgaccgtggggcgatgtaacgtacgggcggtgcgcccgcatccgcatcgttgggtgcctcgatatctggcgtgagtgctttgaataggcgcaggcggaatcggactggatatggcgcgggagctcgaagcccggattgtggcgagcatgtgaatgcgacacgccgagggttgctgatgtacggcttatgtgccatactagccaagttgccggttgagacctcaaccgaaaacgatggcggatttcccaagcggtcaaagggacctgactgtaaatcaggcgcttcgtgcttcagtggttcgaatccactatccgccacgcctcgatagctcagtggtagagcacttccttggtaaggaagaggtcgtgagtccgattctcactcgaggctcgatggcgggatagctcagctggctagagcgtacgactcataatcgtaaggtcaagagttcgagtctctttctcgctactacgtcgggtaaccggcagcttaacgacaagatgaggtgaattcaatggcaagcaagagcgcagacattcgtccgggcatcacgctggcgtgcaccgtgtgcaaggagcgtaactacattacgaccaagaaccgccgtaacaccccggatcgtctcgaactcaagaagttctgcccgaagtgcggcaagcagaccctccaccgcgagacccgctgatccaaggcttctaagctaatcttaaaacccggccagatggtcgggttttttgttactgtgggctgtatgacaagttttgctgaactcaccaccatggatgttggtggctatatcgaacgtttcgtcgaaccgaccacacgcgtggcgctgatcgaggaggtggaggacgccgactccaaaggcattccgctctgcgtgatcggcggcggttcgaacatgctcgcctctgacgacgaattccacggtgtggtgatccgtgacgcacgccgcaacatcatcgtgccagatgaagcggcccccgttgaaggcggcgactacaccgtgcatgtgaacgcggaggccggcgtgaactgggacgacctcgtacagttctgcgtggaacggggacttgaaggtcttgaggggctttccggcattccgggcacggttggcgcgagcgtggtgcagaacatcggcgcatatggccaggaggtcgcctccgcggtggaatccgttgaggtgtgggaccgcgaggagaagaagacgctcgatatgagcaatgtcgacatgcagttcggctaccggttcagcttgctcaaacgcagcatgtacaaggctcctggcgtcccgaacgcgcagtattacccgacgccgcgctatattgtgctgtccgtgaccttcgcactcgtgcacaccggaaccggcaccgtgaactacccgcagctggcgagcgcgttgaatgtgaatctacatgaccgcatgcccatcgaccgcatccgtgccgccgtgctcgaggtgcgcgcctccaaaggcatgcttgaggacgccacgcggtaccgtgagcctatcatgatgggcacgaagcgcgcagaccaggtggaggctgccatcgccgcccagcatgctttccgtgagcagcatgatggtgccgctcgggacatgatcatcgacatcgcttccgacaccggcacgaattccgatccgaaccgccgttcttgcggctccttcttcatgaaccccattatcagcgaagctgacgctgcccgtctgccagaggatgcgccgcgcttcccggccacgttgccggatggctcgaccggagtgaagacctccgccgcctggctcatcgaccatgccggcttccacaaggggtacaagctgtctgacgatgcacgggcgggcctgtctacactccatacgctgagcatcacgaaccgcggtggcgctacctgcaatgacatcgtcaagttggccgatgcgattcgcgatggggtgcgcaagcagttcggtgtgacgctgattcccgagcccgtgctcgtgaacgtgacattgtgacggtgccggacaatctggaccgtattccagatggtgcacacccgtgttctgtgttcatacggcgatattcgaagaaacgcccatatattgttccttggggagcaatatatgggcgtttcccgtatatgtggccggatttgttacgctgtgcggattactcagagcgtaatccgtaaacaaggggtcgtactatgacgtcaatagaaccgacagagagccaaaagcacactggaccggtgagtttgttcatgggagtataagggcacatcgtgcagatttttagaacgaagtccgtcgagcagacgctggcggagacagaggaagagggacattctctcaagaggaatcttggctggtgggatctggccgtcatgggcgtggccgtcgccgtgggcgcgggcatcttctcggtgggtgcgcaggctgcggcattccacgcggggccggcggttatcatcagtttcatcatcgccggcatcgtgtgcggggcggcggtcatgtgctatgcggagttcgcgtcggtgatgccggtggcgggttcggcgtacacgttcacgtatgccacgcttggtgagattttcgcgtggatcatcggctgggacctgattctcgagatgctcatggccggttcggtcatctccaagttctggggcgtgtatctcaacgattttctgcgtctcatgggcgtcaacttcaacacgaacatcatgatcggctcgttccatctcgacatcgcgcccatcgtgatcgtcgcgttcttcaccacgctgctggtgctcggcacgaagatcggcgcacgcgtggacggcgcgatgaccgtgctcaagatagccgtcgtgctgttcgtcgtcatcgtcggcttcttctatgtgaaggcctccaactacacgccgttcatcccgccggcagaaccctcggcggacgtggcgaatgcgaccacggtgcacgggaccctgggccaaccgctgttccagtggcttacgcatatgagcccgaccatctacggtgttccaggcatcatctcgggtgctgcactcgtgttcttcgccttcatcggctttgacgtcgtcgccactgcatccgaggagacccgtaatccgaagcgtaacgtgccgctcggcatcggcgtgggcatgtcgctcatcatcgtcatgtacgtgctcgtcgccatcgtgaccaccggcatggtctcctacaagcagctcgcctccgtcgagagcccgtcgctggccactgcattcgagttggtgggggcggactgggccgccaagatcatcagcttcggcatctgccttggcttggccaccgtggtcatggtgctgctgttgggactcacgcgcgtcgtgttcgccatgagccgtgacggtttgcttccgcgtaccctttcgaccaccggcaagcacggcactccggcacgtctgcagattgtcgtcggcgtggtcgtcgccatcatcgccgcgtgcttcaacattgacgtgctgagcgacatggtgaatatcggcacgctttccgcgttcacgctggtggccctcgccatcccgatcatgcgcaagcgcaggcccgatctgaaacgcagcttcagaatgccgggcaatccgtgggttccgctgctcgtcgcgcttgcgaacttctacctcatgctgaacctcaccgtgctcacttggattcgcttcctcatatggctcgtggttggcttcatcatctactttgcctacgggtacaaccatgcgcgcgtgggcaccggtgaacttgacgccgaggtggtcaaatacgagaagcagcgccagctcaaggcgcagcgcgcgaaacagtccggttccgtcggccgggggaatgacgcggccgtgaccaaggtcgaagccggcaaagactgaaatcgatttgcccgccatttcacacgccagtgctgaatggacggtgaatggcccctattgccgctttgcgcacgcgcggacatgttcgccaaggacatgcccgcgctttgttttatgggtgtaggcgggtagtctggtagggactttgagaaacaaggaggagccatggcctacgtgatcgcgcagccctgcgtcgacgtgaaagacaaggcgtgtgtagacgaatgcccggtggattgcatctacgagggcaagcgctcgctgtacatcaatccgaacgaatgcgtcgactgcggcgcatgcgaaccagtgtgcccgaccgaggcaatcttctatgaagacgatctgccgccggagtgggagtggtacaaggatgccgccgttgagttcttcgccgaggtgggcgatctcggtggcgcacaggctgccggtcccattggcaaggatccgcaacgtgtcgccgatctgccgccacagaacgccgcctgagcatagtaatctgcaatcgcgtgcgccttcccaggcgcacgcgatgccatagtgatacaagtcactcgcattcgcccgtattcgtaggagagccatgggattcaaggatttcagcacaccatatgattggtctcgcgtcggccggtacaaacgcatcgcgcaggcggtgcccggtggcatggtcgatctgtcggtcggttcgccggtggatgcggtaccggattccgtgcgcaaggcgctcgccgtcagcgcgaacgacgcaaacgcctgtggctacccggtgactggcggcacggcagacctgcgccgtgcgatctgcgaatggttccgcggctgtcgtgatgtggagatcgaggcgataggggctgatgtggtgccgacggtcggctccaaggagggtgtggcgatgatggcgtcgctgctccaactcagctccggcgatgtggtagtccaaccgcgcgtgagctaccccacctacgagatcggcacccaggtggctggtgccacggtggtcaaggtcgacgacgtcgccgcagtggattcatggcgcaacatacccggtgtgaaggcgatctgggtgaactcgccgagcaacccgacaggcgcggtgctctccgccgcgcagctgcatgacatcgtgaacgccgcccgtgagataggcgccgtggtgctcagcgacgaatgctatgcgttgatgaactggaccaaggccaatgacgacgaggggaaccgcgaggccgccatcgagtcgtccccctgcgcattgcgcgccgacgtgtgcgacggacgtgcagatggtgtggtcgtgttgtattcgctgagcaagcaatcgaatatggccgggtaccgtacggcactgctcgcaggcgatgcacagatcatctcgcgtatgaccgcgttccgcaaacagctcggcctcatcatgcctggaccggtgcaggcggcgatggcggccggcttacgagacgcggcatcggtgcgtgcacagcacaaccggtatcatgaccgtctcggtgagctcgtctgcgcattgcgtggctacggatatcgggtgaacatgccccagggagccttgtacgtatggacgaaggcgaagtcggctgattgctggaccgatatgaaagcgctcgcctccatcggtatcatcgccagccccggcgaattctatggtgctccggaatatctgcggttctcggccaccgccaccgacgagcagattcaccgggcgtgtgagcggctcgcacaggcctgacgccgcctcttattcaattgctcgtattgggcgcatgctatgcgccgagatgtgcgctatcctgcccgaatttacgccggatctggtctactgcctcttcagcgcagcgcaggcgtgtcgacctcgtgccgtttgcgggggagggaatcgatgacgatgcctgtggcatgggggccacacgctcgttctcctcgagcagttcatcgagcgtgggttggatcaccgtctcctcacgctttgtcaatgtgctcgtgctgatgccggcgagccgtatggggcgtgtgagtttgacctcagtgccgcggcaatccgccggcatgcccatcatgcgcaacaacaggtcgatggcatgcgggtacaacgtgctcgcggcgtcggtcggttgttccagttgcatctgcttggtggagtaggcaaggtcggggaaccgcagtttcacggtgagcgtgcgcgccatgagccccttggcgcgcagtatggaggcaaccttgtcgcagcattgtttgatcagcgtgctcgctgtggccaaatcattgcagtccgtatcgaaggtgcgttcctgcccgattgatttctcgggggcgtgtagcgtgagtgtgcacgggtcgatgccatgcgaggcctcccacaggtgtgttgcggcggctttcgatccggtcgcctgtatgagctcctccaccgaacagcgtgcgagctgggacacggagttgattccccatgcgttcagccgcttctcctgggcggggccaagccccggaatgcctcgcaatggcatcagctgcacgaactgcgcatgcttgtccagcggaatgagcagcatgccgttcggcttcgcattcgtgctcgccatcttcgccacgagtttgttgccggctatgcccaccgagcaggtgatgccgaaccgttccgcgacctgcgcccgtaaccattgggctatgcgcgtcgggctgtgccatgcgagcagcgcaccggagacatccatatagcattcatcgacggagacctgttcgatgcggtccgtcacctcgcggaagaccgtgtggaagatctcatgggagacggcgctgtagtagtggtggtcgacgggcaggaagattccgttcgggcagagttggtgcgcgcgtgcggccggcattgccgaattgatgccgtacttgcgggcctcgtagcttgcagcggagaccacggcgcggttgccggttcctacaataaccggtttgccgcggaattccgggtgtcttgctatctcgagcgaggcgaagaacgcgtccatgtcgatatgcagtatggtgcagccggtctcgtcatggccccaatcccttttggcagcttcgatacgcggtgctgtgctcatgtctcaactgtacctgaacagatgttcgaatggaagcgccggtgtattcgcgcccgtcgcggaacagggaggggctccacaacaaggtcgttttcgctgaattggcgaatatcggtgtttcgtctgtcgaatctgctatgatgttcttttgttgcgctaatgcagcatggagtcatgcctgagtggccgataggggcaccctgctaaggtgttagtcgtgtttagcggctcgagggttcgaatccctctgactccgcgatcagggcgaatccgttgggatccgcctttttccgtttcggacggcttctgtctgttccatgggttccagtagggttgcacgtcctgtgtcggccatttcgggcgagtcgaacgacattgattgtcgtatgccattccctgtcgtcaaatccgcgatatgatgtgcacaatggccagcaaggggattgtgaagttagttgaagcagcggtacgtcattgtccgttgcttcgcttgccgagtgtagtgcaacggcatgcgtgaggcaaatcgccggtctcgatatgagacgggtccgaggtggtctgctgtggcattcgattcggaaactcgcggaaatatggtgccgctacagtgtcggccatgacacagattcttgagacccaaccggaacgcaccgatctgcccctcacagtgatgccatgtgtggtggccgacatgatcgagccgttcaaggcgaacttcgaggtgctacgcgatgtgacgcgcctgagaatgtacactgacaccactctggacccggacgagatcgtgcggcgttgcgagggtgccgacgccgtgattgtgatcggcgtgcacatcgacgacaatctgtatacacggctcacgcatacgcagggacatgcgaagtgcttcgcattcggcggtaccggggtggccagctacatcgacctcgcccgtgcgcggcaggatggcgtgcgcgtatgcaatgtgcgtcgatatggggacgccgcggtcgccgagctcgccatcgcgctcatgatggagttggcgcgccatgtaggagagctcgacacgcaggtgcgcgagggcagttggcatggtgtgttcggcaccgagctcgccggcaaaacgcttggtcttgtgggattcggtggcatcgggcagcatgtggcgcgcatcgccaacggttttggcatgcgaatccaggtttggaactcgcatgtgcacgccgacgcgctcgctgcgaatcccgagatcgcgctcgtcgatggcatcgacgacctcatggccaccagtgacatcgtgtcgctgcatttgccgctcaccgatgagacgcgtggcggcatcaccttcgagaacctgaaccatctgcgacccggaagcatgctcatcaacaccgcgcgcgccgagatcatcgcgccgggcgcgctcgaacggcgcttggaacgcggcgacctgctggccggtctcgacgtgttcgacaaggagccgttgccgcaggattccccactccgttcggttcccggcgtcgtgctcaccccgcatgtcgcctggcgggccgatggcgcctatgccagcctgacccgacaggtgatggaggcgatcgtctcgttctacgagggcggcgatttcaacgtggtcgtctagcgggcggtagtgtggttctgcatacccagaagtgacgagaccgtttgcgaggagccatgcgtaccttgttgaatccggccgacgagccggcgcacgatgcattcgtggagaagaagtccgagttcataggcgacgcctgccatgtcgattcgcttgaggatgcgctcgcgttcgtcgagaccgtgcgcgagcgtcacccgaaagcacgacatgtggcctatgcggcgattgtgaccggtgacgatggccgtgtgatggagcgcatgagcgatgatggcgagccgagcggcacggcgggcaagccgatcctcgatgtgttgcgtgcgaatgaactcacagattgcgtgattgccgtcacgcgatatttcggcggcattctgctcggttcgggcggtctcatccgcgcatactccaccggagcgtcgattgcggtgaaggcagcggatgtcgcacagattgtggtctgtgcccggtatgcggtgccgctcgactactcgcagctcgggccgatgcgccatctggtcgaggtgatgggcgcggtggaggagtctgccgatttctcggatcacgtggtgctcatcgtgctcgtgcgcgatgatgcgcgcgaatcgttcgaacatcgtgtgcgcgagcagttcagtgcgacggtgacgccggagtatgtgggccgatgccaccgcgcgatgcggtgacacgccgcacgccgcctcgtgatgccggtgccgcgcccattgccgcatgtgcattagacttggggtgcacggcacggagcgcagacgatgcgcatgaggtggaggtcagcatggcagatggcgagcagacggcacagactgcgcggaatacgcaggcggacggcgtgcaggacgcggccgggaatcagggggaggcttccgaagcccagactccgcagttcgaaccgctcaccgtgacctatgaacgtctgcgccattcgacggatccgcaggagctgcacgaattcgcacgcaggccgttgccggatcgcgcgaaacaggcggcgttctcacgtgcgacggcattgctcgaggcggtcgccggcaatcagcacacgccgttggaagaccgcgtgttcctcgcggagacgatgccgttcccgaatgtgctcgtcaagctgtctgaagacccttcccccgaggttcggcgtgcggtcgccgcgaaccgcgacgacaagaactggctggtggggcgcctgaccaaagacgaggtgcccgaagtgcgcgacgaggcactgcgtaatccgcagacgtcatggaaaatgcgcatggagggggcgcagaatcctgaggtggacgcgcagaccctcgattttctgagcagactcggcgttgaacttgagccggacgctccgcggatcctgtcgacgatggtgcgtcgcggcgtggcgctcaatccgaatgccggtgcggagacaatcgagcgactcaaggaagatccggtgcccgaagtggcgaaggcggcacagcgccggtgaccttccgagcgtaacccacggctatctcggtgagaggaatgaaaacgtttgctcctttatgggcgtagccgggaacgtcgctgcgaaaaaggcttacacttaggagttatggcagaactcaacgaagaaagcccggagcgtcttgcgcgcccccttattcgtctcgcgcagtcgctgggcgtggcgaccagttatgtcggcatgtcgcgtgatttccatgagattcccgatgacgtgctcgtggccgtgctgaaggccctgaatgtcgatgcctccagcgaggagaccatcgaagtgtcgttggaacatgtgaacaaccagcgcgccatgcggctcatcgaacccaccgtgctgcacattgtgggcgagcagagtcacgtgcccatccatctggccatcaccgaggcgccgaaggtcacgatcacactcgaagacggcaccatataccaacacgacatcgcggtggagccgctgcccgacgtcaaggtgcatgaagtcaacggcaagttcttctcgacggcgcagatcgcactgcctgccgacctgcccgagggctaccacacgctgcatatcgcggcagggcagcgcgaggcggatgcgacgctgatcagcgcgccacagcgcatcccactgctcgatccgctcaagaacgggtcgttgtggggctggatggcccagttgtattcgatccgctcggccgactcctggggcgtcggcgatttcgccgatctgcgcacgttgctcatcgactcgaagcggtacacgaacgccgacttcatgctcatcaaccctgtgcatgccggcgaaccggtctcaccgctgaccccgtcgccatacctaccggtgtcgcgtcgcttcatcaactacacctacattcacccggaggacattccggagtactacgcgttggacgatgccgccaagcagtccgtcaaggacgcgcacgccaagatggaggcctacaacgccgatccgaacctgatagaccgcgatgccatgtggctggagaaagagaaggcgctgcgcacgatcttcaacacgggcctgcagtcggtgcgccagcaggccttcgacgactacaaggccaggtgcggcgaggacctcgaggcatacgccacctggtgcgtctgctatgcgaagtggggcaagccggagaacacgccagacaattggatcaacaagtacacgaaggattcccccgaggtcaagcagctgcgcgagcagaacagcgacctgctcgaattctaccgttggctcgagtggattgcggtcgagcagatgcatgcggcccagcaggcggcacgtcaggccggcatgaagatcggcatcatgagcgacatggctgtgggcgtgcatcccgacggctccgaggtgtggtggaacccggagcgattcgccaatggcgccaccgtgggtgcgccgccggacatgttcaaccagcaggggcagaactggagccaacccccgttgagcccgctgtcgctcaaggaaaccggctacaaggcgtaccgcgagatggtgcgtggcatgttcgactgcgccggtgctgtgcgcatcgaccacattctcggcctgttccgcctgtggtggatcccggagggccagccggcctcgaatggcacctacgtgtactacgaccacaacacgatgctgggcattctcgcaatcgaagcagaccgtgttggtggtctgatcgtgggtgaggacctcggtgtcgtgccgtcgtacgtgcagcagtcgctcgccgactatgccatcttcggctgcgccgtcgaatggtttgagcagatggatggcgtgttcattccgccgaaggattggcgcccgtatgcgttggcctcggtggacaaccacgacatgccgccggctgccggctatctcgagtacgagcatgtgcgcgtgcgcgagcagctcggtctgctcggcgaggattcgtcggccttcgagcgcagcgcgcgcgccgagcatcaggccatgctgcagatgctcgtcgacaacggctacctcgatgtcaatgtgatgaaagacgaatccggcaggtgggaggagatcgtcgaggcgctctaccgtgcgctcaacagctcgccttgcaagctcaaggccgtctccttcgtcgacgcggtgggagaacgccgcacgcagaaccagccgggcaccgacaacgagtatccgaactggcgtgtgccgttggccgactaccacggcgacaacgtgccgctcgagcacctgttcgactccgatctgctgcagcgcatcgccaagatcatgaacagctgatgggcggccccgcaccttattgcgaaagcgccggcgtatcgatattgcgccggcgctttgccgtctgtgaacggggtgcgggagagtgccatcgcgcgtacgcgtatgtcaagccgagggatataataaaggattgttgtgtttccctacggggtccttcaaagcgctttcccactcgcataaggactttcagggagcccacggtaatgagatcggaacgccgcacggtctgaccaacccgcagcgcgaggatccggaacacaatacagaaaaggtatatcgtgaaaactttcacaccgaagccagctgatcttactcacgactggtacatcatcgacgccaaagacgtcgttctgggccgtctctccgtcgccgcagccaacctgctgcgcggcaagaacaagccttccttcgctccgcatgccgattccggcaactacgtgatcatcatcaacgccgacaagattgctcttaccggcgacaagatggacaaggagctctactcgcactccggtcgtcctggtggcctgcgccgcgacagctacgcagagctgctcaagaacaagcccgagcgcatcatcatgcacgccgtcaagggcatgctgccgaagaacaagctcgcaaaggtccagctgacccgtctgcgcgtgttcgccggcgaagagcatccgcacgttggccagaaccctcaggtctacgagatcgagcagatctcgcagcaggcaaagtgaaccgaaggagataagaacaatggctgagaataccaacaactccgcggttaccgagaccgaggaaaccaccgccgccttcaccaccgagaccaactcgggcgcaggcaccggcacctccacgatcgctccgggctatggcaccggccgtcgtaaggaagccgtcgcccgtgttcgcctggttccgggcactggcgagtggaagatcaatggccgtacgctcgaggagtacttcccgtcgaagctgctccagcgtgaagtgaactcgccgatcgtgctcctgaagctcgaaggtaagttcgacgcaatcgtgctcgtcgacggtggcggcaccacaggccaggccggcgcaatccgcctgggcgtggctcgtgccctcaacgccatcgaccgcgatgccaaccgcgcagcactgaagaaggctggcttcctcacccgcgacgcccgcgtcgtggagcgtaagaaggccggtctgcacaaggctcgccgcgctccgcagttctcgaagcgttaagcgttatacgcgaagaaggccgccctgcaatgcagggcggccttcttgtttttcggaaggcgtcgagtccatggccgctggttcaggtcgtggactcggctcgccactcaccaggagcggcgctccgattgcagcagcaggcttatgctcagcgccgggaaggtccacacgttcgatgggacggcattgggggaacctgcagccggagcggtgtcttcgggcgtaggggcatcgtgctcgacgtcgaatgcggtggtcgtgggatcggaatcggccatgctgatgcgtgtggggtcgccggttccggagtgtgcaccggcggtcatcggcggcatctgctggtcgagtgtgtctttgatcttgcggtcgagaatggattcgaggagctgcgtctcatgtgcggtgagctttgccgttggcttggtggttccaatctcctgacgggcggcattctcctcggcgtccgcgccaacggcaccatgggcgtcgagatcgtgcaggggcgacgtcgcacgcttgaaccgcagcgtctccgcaagtggcgacaccgccgcagaccgtaagatcttggtgacggaggtgcccggtgcgggctgttcgccagtggtctgcgccgacgaccatagcagattgaacgtcgaatccgacggcaggtgcatccggcggtcggtttcatcgccgttgaccacaatcagcgcgtcgggttcgtccttgaaatacaagtgcatcatgaacgagcgcaccgacgggtcgcgccaatcggaatccatgggcatcgtgccatccggcaggctccactgcacacgcgagctcggcttgagcagccccaactgggagagcctcgtgaagaagtcctcgtgattgtatatgtcgagcgatttgcgcacggcgatcagattcgcggtggcctcgagttggcgggattcggcggtttcctctgtgcagttgatccaatcccagtcgagccaggcgatctcgttgtcttggcaatacgcgttgttgttgccgtattgcgtgttgccgaattcgtctcctgcgagcagcatgggcgtgccaagcgagagaatgagcgtgccgagcatgttcatgcgcgaacgttcgcgtgcgctctcgatgctgaggtcgtcggtggggccctccacgccgaagttggcggaatggttcacgttcgtgccgtcgttgttgttctcgccattcgcctcgttgtgcttgtggtcgtagctggtgaggtcggccagtgtaaagccgtcgtgcgcgctgatgtaattgatcgatgacgtggcgccacggcccgggtcggtggcgaacaggtccgccgaaccgcacaggcgcgtggccatctcctgcatggtggtcacaccatggcccgcagtctggttgatgtcggagagccagaactggcgggaggcgtcgcggaatcggtcgttccactctccgaagggcgagaggaactggccggtgcgccacccttggaagcccagatcccacggctccatgatgagcttgaggttgccgagcagctggtcggaacgcaatgcgtacaggaacggatggtatggggtgaacatgcccttgagccgcgccagcgagacggcgaggtcgaatcggaagccgtctatgcctatgcgcttggcccagtaccgcagcgaatccacggcgaatgtgatgttgtgggtgtcggtgaagtccacggtgttgccgcagccggtggtgtcttcgagctcgccggcatgctgggtctgctggcggtagaacgagagattgtcgagcccacgccagcagacgctcggcccggcattgccgccctcgcaggtgtggttgtacaccacgtccatgatcacctcgaagccggattcatgcagggcgcgtaccatgtcgatcacctcacgacgcacggcggcggcaccggcctgttgagccttcttcgtggcataaccgggctcaggggagaagaagttgagcgtggaatagccccagtagttcgtgcgcacgcgttcctgcaggaacacctcgggctgcttggccatgatcggcaacagttcgattgatgtgacgcccagatcctgcagataggcgagtgtggtggggtgggcgaggccggcgtaggtaccgcgtagctcctccggcaaccatggcgcgttcttcgtgaagcccttcacatgcagctcgtagatcaccgttttgctccacggcacatgcgggtgttccgggtcgccgtcgtgcttgcgggcgtcacggtcgtcgatcgccaccgacaccgggcaatggcccagagaatcgagcgtgctcatttcaccccaggagtctccttcgaccttgccgtcgtcgcctatggtgcattggtacgcgaacatggaagggtcgagttgcatcgcccgctcaatgcccttggcataggggtcgatgaggaacttgtacgggttgaaccgcaggccgtgatgcgggtcccatgttccgtcggcgcggaatccgtattgcagaccgtcccatgccttgtcgagatggaggttccacaggccatagttcgggccggtcatcttgaacaatgtctcgcgcaggccgagcgcaggcacgatgcgcgagcagatcgggtaatggcgcatgtagtcgaggagcctgtccgctgcgtcatcgggcaggcgaaccgcctggttgtagaacgcgctcggtttgtccaccggctcgagcacgctcaaccacagttgttccgcggtctcagaacgtaccacgacgtccgcgccgccgtcatcggtgtagaagaagcctggtcgcgtggcgtatcgctgtaatttctgtaactgcatagctttccagtgtaatgggcgaatcttcgaatgaggtgaatgcgggccgccgcactagtcagtcggacggtatgccgtcgtgggaggcggggatgagcgactgcgccgcgcccaccgcgtcctggtactccacgcagcagccgcgcatgacctgcgggttgcgcgccgacggattgacgtgttcggcgcaggtggtgaggcgctcgagctgggcgatctcggaatcgtcgagatagtcggcgatcggtccgcacagaatgacatccgccggcacgaatgtgcgaatgttgttgaccgcatgggcgagcgatccgagccagcggtccatgcgcacatgatgattgcgttcgccctgctcgagcacgccgaagaaaccgggcagactctcgccctcctcggtgagctgccgcgacgagcacagcacctcaaggcaaccgcgcgacccacaccggcagatgtcaccgctcgcatcgagttgcatgtgctcgagattgccttcgcgtgcgacgccgtccatcacgatggcgctgttgatgtactcgcccaggtacaggcacaccgcgttgcgcagcaacgggtggttatgcagttcgacggtggcgtaggcgacgttgcgcgcaatgcgtgagcagggcaatgtgagaatgcgactgatgccttggtacgactcggtggccgcattccagtcctcggccacgcagatgcagtggcgcgccgcgctcgacggcaatgcgaagcacacgccgatcggggagggcagtgactgtgcgaacgtcgagatcgtatgcgcggctcgttcgtagtacgcgttgtcgttgcgacgtgccatcgtcaccttgtgctcggctatcacattgccgcgcagatccaccgccatgcacaccacctcggtgggtcgcaacgcgacgccaatcgccgtgcgatgcctcgcattgaactgccaggtctgggctttgcgccctcctgtcgaggcccgcgcctccgctgggacgatgagcccgtcggcggcgagctcacgcagattctcggtgattgtgggcatgctcaggcgcgtggcgtctgcgatctgccgcttggtcatggacggcgccgcgaacagctcgcgcagtatgagctcgcggttgtgccgcttgacggtcgtgctttccatgtgcttccctgcccgctgctattcgccggcgactctctctatgaccggctcgtgtaggtcaaggatatcggatgccaccagttttgcaaagctgattttcaaaagattcaacaaaacgtggacttttggaaaaggatttgtagaagtgagtggattgtcgagtgcgaaactgtgtgcgcttgtcgatgaaagtgaacaatttgtatcaagtaactcaaattgagatggaaatctgccaattagtgacacaatgagttcatcaaacgcacaaaagagaacagacacacggattgtgattgcagacttgctttccgcagtgcctgttcgctagattgtgagacaactcacatctcgtgaaatctgcgccacggggcgcaccgatttgccgaatctacaggaggttcgcatggcagacaagaacagcgccgagaccgcaacgaaggcggccaagcttgctgtgaatgtggaagacaagaaggccgcggcacaggccgaggtcgacgctctggtcaggaaggcgcagaaggcgctggcggaattcgaaaagctcgatcagcaggccgtcgatcgcatcgtggcgaaggcctccgtggccgccctcaacaagcatctggtgctggcgaaactggcagtcgacgagaccggtcgtggactcgtcgaagacaaggcgacgaagaacatcttcgcctgcgagcacgtgaccaattacatggccggtcagaaaaccgtcggcatcatccgcgaagacgacgtgctcggcatcgacgaagtggcagaaccggtcggcgtcgtcgcaggcgtcaccccggtgaccaacccgacgtccactgccatcttcaagtcgctcatcgccctcaagacccgttgcccgattgtcttcggcttccacccgggagcgcagaagagctccgtcgaagcggcgcgcatcgtgcgtgacgccgccatcgaggcaggtgccccggagaactgcgtgcagtggatcgaacacccgtccatcgaggcgaccggcgcgctcatgcagcatcccggcgtggccacgatcctcgcgaccggcggccccggcatggtcaaggccgcgtactcgtccggcaagccggccctgggcgtcggcgccggcaatgccccggcctacgtcgacaacaacgtcgacgtgcagcgcgtggcgaacgacctcatcctctcgaagcacttcgactacggcatgatctgcgccaccgagcaggcgatcatcgcgcacaaggacatctacgcaccgctcgtcaaggaattgaagcgccgcaaggcatacttcgtcaacgacgaggagaaggccaagctcgagaagtacatgttcggctgcaccgcgttctccggcgagaccccgaagctcaactccgtggtcccgggcaagtctccgcagtacatcgcgcacgaagccggcttcgaaatccccgaggacgccacgatcctcgctgccgaatgctccgaggtgggcgagaacgagccgctcaccatggagaagctggcgccggtgcacgccgtgcttaagttctccgacaaggagcagggcttcgaaatgtgcgaggagatgctcaagcacggtgccggccataccgccgcaatccacacgaacaacgacgacctcgtccgcgagtacggcctgcgcatgcacgcctgccgcatcatctggaaccagccgagctcgctcggcggcattggcgacatctacaactccatcgccccgtcgctcacgctgggctgcggttcctacggtggcaactccgtctccggcaacgtgcaggcgatcaatctgctcaacatcaagcgaatcgcgcgaaggaacaacaacatgcagtggttcaagatcccggcaaagacgtacttcgagccgaacgccatcaagtacctgcgcgacatgtatggcatcgagcgtgccgtcatcgtgtgtgacaaggtgatggagcagctcggcatcgtcgacaaggtgattgaccagctgcgtgcacgctccaaccgagtcaccttccgcatcgtcgactatgtggagcccgagccgagtgtcgagaccgtcgagcgcggcgccgccatgatgcgcgacgaattcgagccggacacgatcatcgccgtcggcggtggctctcccatggacgccgcgaagatcatgtggctgctctatgagcacccggaaatcgcgttctccgacgtgcgtgagaagttcttcgacattcgcaagcgcgctttcaagattccgccgctcggcaccaaggccaagcttgtgtgcatcccgacctcgtcgggcaccggctccgaggtcacgccgttcgctgtgatcaccgaccacaagaccggctacaagtacccgatcaccgactacgcgctcacgccgtccgtcgcgatcgtcgacccggtgctcgcgcgcacgcagccgcgccgactggcctccgatgccggcttcgatgcgctgacccattcgatggaggcctacgtctccgtctatgcgaacgacttcaccgacggtatggcgctgcatgcctgcaagctgatctgggacaaccttgcggagtccgtcaatagcgagccgggcgaaaccaagaagaaggcgcaggagaagatgcacaacgccgccaccatggccggcatggcattcggatccgccttcctcggtatgtgccacgccatggcgcacaccatcggcgccctgtgccacatcgcgcacggccgcacgaactcgattctgctgccatatgtgatccgctacaacgggcaggtgccggaggagccgacctcctggccgaagtacagcaagtacatcgcgccggagcgttaccaggagctcgcctcgctgctcggggtcgacccaggcaagaccccggccgagggtgtcgagaatctggcgaaggccgtcgaggactaccgcgacaataagctcggcatgaacaagagcttcaaggattgcggtgtggatgaggactacttctggagcatcctcgagcagatcggcatgcgcgcctatgaagaccagtgcgcgcctgcgaatccgcgcatcccgcagatccaggacatgatggatatcgccatcgccgcctactacggcgtctcgcaggcggagggccatgcgatgcgcgttgagcgcgaaggcgtgggcgccacggaggaagcctccgagcgcgtctgatccgccaatccattgcaatctatatgcaatccattgccaatgggccatccgccagtcgggtggcccattctgatgtcagcaatctgggttctgtgcaatatggaatctgcaaatgggaggaaaaaccgcgcgcgcatgttttcttcccgcgagcgagagcccagatgagaagaaaaaggaatccgtggtttttcttctcgtttggcagttcctagcgggaaggaaatatagaagcaatgtttttcttcccgcgagctatgccgtaactgggaagaaaaaccatacgcgcatattttcttccaatctgcgttccgctcacccaatgattgccacccgatacccattgatgtctgtcgatccaagaaagtgggtgggtacgccggcgctgtgcagtttcgcatgcaatcgctcgctgtgaatcacatcgtcgaacgtgaagcgcacggttctgtgcacgcctgccctctcgagcgccttctcccgctctcgttcgtcagccacgacggcgtgcacgcttcgactgcccgtcatctgcggatcaatatatttctgcgcgccgtccagttccgcgacaatcaccgttccgtcgtcgcaaacccagtaataatcggcgcggtatatgtgccctgtttgcggatcggtgagtggtacttgctgttgcggcttcctgaaaccatatcgcgcggtcatcactgcgtgcgcataggcttcaccgccgttctcgctggccggattgacatgtggcagcagggtgaccactgcatccgtgccattcgcagcacattcccggagcagctcgcgcgtggagagccccgtcttgaagcagccgtccaacgctgtgatcgccgcgcacggctccatcgtgagcacacagtccgacgcggtgcagacaagcggcgtcacgggaataccgtcgattatttcggcgcgcatattcgggtggcggatgcgttgcagacgcgggccgtcagatttctgcggacccgcggtgcaggcgatggtcacgcggtgagtcaatgcatgccatggaatttgtagattccgcacgcaggccgctgtctctccgttgaacacccaatcaggatggcttttcgccagcgcgcgtgccagatacacgatttgcacgggaggaggcagcgtgcgccagaattgcgcgtgtgcgtacatgccccgatatacgcgcacgagttcgccgcctgcgcatcgccgcgccagcatcttcgcctgacgggaatcggatgcgcagatgcagcgttgctgccgacgggcctcgcaatcgagctcggtcattccctgctacttctcataatccgacggtaagccgcgcgtgcatgcagcgccagccggcagcggcattgtggtttgttgacggcgtgaattcgctctggcatgtcttgggacactcgcgtaggctagggcagcatgatctcctcaatctctacgcgatccgtgcgcgattggcgttcgaatgaacccggcgcatgggtgatcgtgctcatgcccgcgctcagcgccttcctcgtctccggtcccacatggaactccgtgtggctgctcgtattgtggtgcctgtgctactgcgtgcagttcagtgctgcacgatgggcgaaatcgcatgggcgcgcacggtatcgcatgccgatgctcgtctatgccgcgctgctcgtctgcgccggattgccgttcgtgttcagattccccggcatgctatggtgggctccgatctactgcgtgctgtgcgcggggtcgctaatttgtgcatggcgacgccgtgagcattcgattccggcgaatatctgtgcagtgctcgcctccagtaccatggcgattcccgtcgcttcgctcggcacgcatggtggggacgcccccgcccttgcgcatcttctgccgttcggccagagcatattgccgccgcttggcgtggagatcgcgggcgcgtacgcgctcacgctgttcggcagtgtgctctatgtgaagacgatgattcgcgaacaggggaatacccggtatctcgctgcctcgtggatctggcacattctcgtcatggccatcggattcctatacagtccgatctatggctggttgggggcgattctgctcgcgcgcgccgtcgtcatgccggtcgcgacgcgcaatatgaggaagactgcgaagatcgcgggaataggcgagtgcgtgacgagcttggtctctttcgtgatgatcacctatgccgctacggtgctcattccgtgacgggactgtgaagacgtcagggtgaatgcgacacgccatcgccgccagcggaagaaaagaccacccccggtgcttaaatatagaagttgcctgattagggctcgcataattggaatcaaaaaagcgagcgcggcacaaaagcccgcacgggtttttgcatggctgcgcactgatgtaggaaaagtcggcggacgtttgcccaaagacttcactcgccggtgccctggagcaggttaagtcacattgatacacgaatcgctagaaagggcggaaggcaatggcgggacagaaaatccgcatcaggcttaagtcctatgaccatgaggtcatcgaccaatcggcgaagaagatcgtcgaaacggtgacgaacgcgggtgcaactgtggttggcccggttccgctcccgactgagaagaacgtctactgcgttattcgttcccctcacaagtacaaggattctcgcgagcatttcgagatgcgcactcacaagcgtctcatcgatattgtggacccaaccccaaaggctgtggactccctcatgcatattgatctgcccgcagacgtcaacatcgagatcaagctgtaaggggaggaggaaccgcaatgtcgcagaacaagaatcgcaacgcactgctgggcaagaagctcggcatgtcgcaggtttgggacgaaaacggcttcttcgttcccgtcacgctcgtcgaggtctcgaccaacgtcgtcacggctgtgaagaacgaggagaccgacggctacaaggccgtccagcttggctacggccaggtcgacccgcgtaaggtgaccaagccgatggccggtcatttcgccaaggccggtgtgacgcctcgtcgtcacctcgccgaagttcgcaccgagaacgtagaggatttcgagcccggccaggagctgaccgccgaggtcttccctgagggtgtgcaggtcgacgtgaccggcaccaccaagggcaagggcttcgcgggcaccatcaagcgctggggcttcaagtcctaccgtcgtacccacggctctcacaagaacgagcgtcgtccaggttcggttggcgcatgcgcaacgccgagccgtattctcaagggcaagcgcatggccggtcgtatgggccatgtcaccaataccgtgcagaacctcactgtcgtctcctccgatgtggagaacggcatcctcgccatcaagggcgccatcccgggcccgaagggcggcatcgtcctcgttcgttctgcagtgaagggagcctgatttagatggcaaacgttactctgaacgtcaccgataacaatggcaaggaagccggcaccctcgaggcgccggaagcgctcttcggcttcaccgccgaggaagtgcaggcacacgtgccgctgatccaccaggttgtggtggcccagcgtgcagccgcccgccagggcacgcatgcggtcaagaaccgcggcgccgtctccggtggtggccgcaagccgtggaagcagaagggcaccggtcgcgctcgtcagggctcaatccgcgctcctcagtggtaccacggcggtgtcgcacacggcccggtgccgcgtgactacagccagcgcacccccaagaaaatgaaggccgcagccctgcgctacgccctctcggatcgcgccaacaacggtcgcgtcgcagtcgtcgacttccagctcgacgcaccgtccaccaagaaggcaatcgcggctctcgccccggtcgtcgccgacaacttcaccaccgtggtgctgtcccgcgacaacgtgaacgagtggctgtcggttcgtaacattccgaccgtctacccgatcttcgccgatcagctcaacacctacgacgtgatcaccgcccagtacgtggtgttctcgaaggatggtctcgaggctttcgtcgccgcgaagacggcagctaaggaggcctgagttcatggtcgctattcacaagccagcacatgacatcatcctgaagcctgttgtttcggagaagagctacgctctgtccgatatgggtcagtacaccttcgtcgtggccccgaacgccaacaaggtgcagatcaagcaggccatcgaggagatcttcaaggtcaaggtgacgaacgtcaacaccctcaaccgtgcaggcaagcgcacgcgcacccgcaccggttacggccgccgcgtcaatcagaagcgcgcaatcgtgaccgtggccgagggccagtcgatcgacatcttcggtaactgaaggttagccgagaaaagttaaaggaaagaactagattatggctatccgcgtatataagccgacgaccccgggccgtcgtaacgcgtctgtttcggacttctccgacctcacgcgctcgaccccagagaagtcgctcattcgcaagaacagcaaaactggcggccgcaacaactacggccgcatgacctcccgccatcgtggcggcggtcacaagcgccagtaccgcctcatcgacttccgtcgttgggacaaggacggcgtgccggcaaccgtggctcagatcgagtacgatccgaaccgctccgcacgcatcgccctgctgcactacgcagacggtgagaagcgctacatcatcgcacctgagggcatcaagcagggtgaccgcatcgagaccggcgccaacgccgacatcaagccgggcaacaacctgccgctgcgcaacatcccgactggtacggttgtccacgccattgagctccgcccgctcggcggtgccaagattgcacgttccgccggtgcggccgtgcagctcgtcgccaaggatggcgcttacgcccagctgcgtatgccatcgggcgaaatccgcaacgtggacgcccgctgccgcgcaaccgtgggcgaggtcggcaactccgaccacgccaacatccagctcggcaaggcaggtcgtgcacgttggatgggcaagcgcccgatcacccgtggtgagtccatgaaccctgtcgatcacccgcatggcggccgtacccgcggtggcaagccgccggtgtctccatggggcaagggcgaggttcgtacccgtcgtccgaagaaggcttcgaacaagatgatcgttcgtcgtcgtcctaacggcaagaatcgcaagtaagggagtgtcgagtagatgactcgtagcatcaagaagggcccattcgtcgacgcccacttgcagaagaaagtcgacgagcagaatgcgaagggcacccacaacgtcatcaagacgtggtcccgccgttcgatgatcacccctgatttcatcggacacaccttcgcggttcacgatggtcgcaagcatgtgccggtgttcgtcaccgaatccatggtcggccacaagctcggtgagttcgcccctacgcgtaccttcaagggtcacgtcaaggacgacaagaagtcgcgccgctaataagtaggagagtatagacacatggaagctaaagcaatcgctcgccacgttcgtgtgacgccgcgtaaggctcgccgcatggtcgacctcatccgaggcaagaaagcgaccgaagccatcaccattctcaagttcgctccgcaggacgccagcaccccggtgctcaaggtcctccagagtgccatcgcgaacgcccgcgtgaaggccgacaaggccggcgagccgttccgtgagaacgacctgtacatcaaggagacctatgtggacgagggtgtgacgctcaagcgtttccgcgctcgtgcacagggccgtgccgctcgtatcaacaagcgtacgagccacatcacggtcgtcgtcgctagcaaggaaggagaccgctaaagatgggtcagaagattaatccctttggctatcgcctgggcattactgagagccatcgttccaagtggttctccgattccaacaaggtcggcgagcgttatcgtgacttcgtcctcgaagatgacgccatccgcaaggtcatgaacaaggatctcgagcgtgcgggcgtgtcccgcatcatcatcgagcgcacccgcgaccgcgtgcgtgtggacatccacaccgcccgtccgggcatcgtgatcggccgtcgtggcgccgaagccgagcgtgttcgtgccaagctcgagaagctcaccggcaagcaggttcagctcaacatcttcgaagtgaagaacccggccatcgacgcccagctcgtcgctcagggcatcgccgagcagctcaccaaccgcgtgaccttccgtcgcgcgatgcgtaaggctcagcaggatgccatgcgtgcaggcgccaagggtattcgtatcaagctctccggccgtctcggcggtgcggaaatgagccgttcggagttctaccgtgaaggccgcgtcccgctgcagacgctccgcgctctcatcgactatggcttcttcgaggccaagaccacctacggccgcatcggtgtcaaggtgtggatctacaagggcgatatgaccgagcgtgagttcgaggagcagcaggcacagcagggcaacaaccgcccgggccgtcgcggcggcgatcgtcgtccgcgccgtggccagcgtgccggccagcgtcccaccggtcagaaccaggtcaagacaggtccggatcagcagatggaagcggaagtttccaaggaagctgccgtagagccggaaactaaggagtgagctgaggatgcttatcccaaagaggaccaaatatcgcaagcagcatcgtcctgaccgccatggcatgtccaagggcggcaacgagatcaacttcggcgatttcgctattcaggcattggctccggcctatgtcacgaaccgccagatcgaggctgctcgtatcgcaatgacccgttacatcaagcgtggcggcaaggtgtggatcacgatcttcccggatcgtcctctcaccaagcacccgctcggcgcccgaatgggctccggcaagggcactccggaattctggattgccaatgtgcacccgggccgtgtcatgttcgaaatcggtggcgtttctgaggatgtcgctcgcgaggccctgcgccgcgcaatcgacaagcttccaatgaagtgccgcgtgatcgctcgcgaaggcggtgacatctgatgccagtcggatcggaagaatacaccatcaagaatctcaacgagaagaccaatgctgagatcgagggcttcatcaagaagtccaaggaagagctgttcaacctgcgcttccagcatgcaaccggtcagctcgagaacactgctcgcctcaaggctgtcaagcgtgacatcgccaggatgtatactgttctgcgcgaacgtgaacttggcatcagccaggctccggcggcaaccgaaacgaaagcttaaggagaagtaatggctgaagagcgtaacttccgcaaagttcgtcgcggttatgtcgtgtccgacaagatggacaagaccatttccgtggaactcgaacttcgtacgacccacccgctctacggtaaggtcgttcgttccactcgcacggtcaaggcccatgacgagaacaaccaggctcacgttggcgacctcgtgagtatcatggagactcgtccactgagcaagaccaagcgttggcgtctcgattccattatcgagcgcgctaagtaacaagttcggcaaggctcgccaatcacccggctcgcccataggagcgggccgggtgattggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggcgacgtgatcgtcgcctccgtcaaggacgcaatccctggcgggtcggtcaagaagggcgacgtggtcaaggccgtcgtcgtccgtacagtcaaggaacgccgccgtgcagacggctcctacatcaagttcgacgagaacgccgctgtgattctcggctccggccgtgaacccaagggcactcgtatcttcggaccggttggtcgtgaactgcgcgacaagcgcttcatgcgtatcgtgtccctcgcaccggaggtgatctgacatggtagccaagatcaagagcggcgacctcgtcaaggtcatccgtggcaaggaccgcggcaaggaaggcaccgtcaagcgcgttctcaaggatgaccgactgattgtcgaaggcgttcagatcgtcaagaagcatgtgcgtgcaacccagcagggtcagcaggccggcatcgtctccgttgaggccccgatccatcgctccaacgtgatggtcatcgacccggagaccaagcagcccacccgcgttggcgtcgtaatcaaggaagaggcacgtgacggcaaggtgaagaccgtgcgcgtccgcgttgccaagaagtccggaaaggaactggcatgagcgaagtcgttgacgaagtcatcatcgaagagccagtgaccccacgcctcaagacgatgtacaaggaagagatccttcccgagctcgagaaggaattccaccacgacaacccgatgcagattcctcgcatcgagaaggtggtcgtctccatgggcgtcggcgccgcagcgcgcgactccaagctcatcgaaggcgctgtgcgtgacctcaccgcgatcaccggccagaagccgaagatcaccaaggcgaagaagtccgtcgcacagttccacctgcgcgaaggccaggccatcggcgcatacgtcaccctgcgcggtgaccgcatgtgggagttcctggatcgtctgcttacgctggccctgccgcgtattcgcgatttccgtggcatcaacggccatcagttcgatggtcagggcaactacaacttcggtctcactgagcagtccatgttccacgagatcgatcctgatgagatcgatcaccagcgcggcatggacatcaccgtggtgaccaccacgaaggatgacgacgaggcttacgcactgctcaagcttctcggcttcccattcaaggagaactgaaatggcaaaaacttgtcttaaggtcaaggcgcttcgcaagcctaagttcaaggttcgcgcctacacgcgctgcatggtctgcggtcgtccgcactccgtgtaccgtaagttcggcctgtgccgaatctgccttcgcgagaaggcacaccgtggcgagctgccaggcgtaacgaagtccagttggtaaatatcaacgctgaaggtccgcggcccgggcaggccatagcagtctgcagggcggcggaaaccacggcgagaaagggcgttagcccaaatgacaatgacagatccaatcgcagatatgctcacgcgtctgcgtaatgcgagcgcggcaaagcacgagaccgtggatatgccgtactccaagttcaagaagaacatcgccgagatcctgaagcgcgaaggctacattgcagacttcaccgccaaggaagcccgcgtcggccagacccttgaggtcaccctcaagtacggcccccacggtgagcgttccattcagggcatcaagcgcgtgtcgaagccaggcctgcgtcgttacgccaagtccgacgcactgcccatgccgctcggcggcctcggcatcgccatcatctcgacgagctcgggattgttgactcagaaggaatgcctcgaccgaggcatcggtggcgagatcgtcgcctacgtgtggtgagaaaggagagctgaacatggcatcgcatattggtaagctcccgatcgagattccggcgggcgttgaagtcaccatcaatggtcaggaattcgccgccaagggcgcgaagggttccgactcctacaccatccccgagggcgtgaccgccaaggtcgaaggcaacgagatcatcgtcaccgcgaacgacgacctgcgtccgacccgcgcaaagcacggcctggcccgttcgatcgtggcctccatggtcaagggcgtgcatgatggctattcgaagagcctcgacatcgtcggcaccggttaccgtgcacagatgaagggcaagggcatcgagttctcgctcggttactcccacaccatcaccgtgaacccgccggaaggcatcaccctcgaactgccgaacccgaaccaggtcatcgtgaagggtaccgacaagcaggccgttggccaggttgccgcgaacattcgtaagcttcgtgctccggaaccgtacaagggcaagggcatcaagtactcggatgaggtcatccgtcgcaaggctggaaaggctggtaagtgatatgagcgttaagattttcggtaaaggcaagaaggccgcgctgaagcgtcgccacgctcgtattcgcaagcgcatcagcggcaccgcagagcgtccgcgtctcgtggtcacccgctccaaccgtcacatggtcgcgcagatcgttgacgacaacgccggcaagacgctggtgagcgagtccacgcttatggccgatttcgccgacttccagggcaccaagaccgaagccgccaagaaggttggcgagctcctggccaagaaggccaaggatgccggcatcaccacggtcgtgttcgaccgcggcggcaacatgtaccatggtcgcgtcgcagctgttgctgaaggcgcccgcgagggaggtctggcactgtgagcgacaacgaaaaggaaacccaagtggctgaagagactcagaacactcaggcaaccgccgagtccagcaacaacgacgagcgtcgtggccgccgcaacaaccgtggtggcgaaggtcgccgcggtgaccgccgtggccgtcgtgaggacaatcacgagaacgagatgctcgatcgcgtcgtgacgatcaaccgtgtgtcgaagacccacaagggcggccgtacgttcagcttcgccgctctcgtcgtggtcggtgacggcaacggtaccgtcggtgttggctatggcaagtcccgtgaggtcccggcggcaatcgccaagggtcagctggatgccaagaagcatctgttcaacgttcctcgcattcgcggcaccgtgacccacccggtcaccggccacgaccacgcaggcaccgtcatgctgcgcccggcagctccaggcaccggtgtaatcgccggctcggctgtgcgtgcagtgatggaatgcgcgggcatcaccgacatcctgacgaagtcgatgggctccgcaacggccgtcaacgtggttcgcgccaccgtcgatgcgctgaagcagctcgaagagccggaggagattgcggcacgccgcggcctctccgtgcaggaagtcgctccggaccagctcctgcgtgagcgcgccgccggcattgccgaggcccgaaaggcacgcgaggaagccaaggccgaagcggccgctaaggatggtgagtgatggcaaagctgaagatcacgctcgtgcacggtgttgcacacgcgaacaagaagcagaaggctaccgtgcagacgctcgcccttcgcaagatcggccagagcactgttcttgaagacaactcgtcgacccgcggcatgatcgccgtcgtgcgtcacttggtcaatgttgaggaggcagagtgattatggctaacgaagagaccacaatcctgcaaatgcatgacctcaagccggcaccaggcgccaggaaggatcgcatccgcgtcggccgtggtgaaggctccaagggcaagacctcgggccgtggcgacaagggcaccaagaagcgctatcaggttcgtcctggcttcgaaggcggccagctgccactgtacatgcgtcttcccaagctccgcggcttccgcagcccgttcaagaccgaatatcaggttgtgaacattgctgctctcaacgatctgttcccgcagggcggagagatcaccgtggctgacctggtggccaagggcgcagtgcgtgccaaccgtccggtcaaggtcctcggtgagggcgaagccaccgccgcattcaccctcaagggtgtcaaggcctccgcttcggcgaagtccaagattgaagcggcaggcggttcgatcagcgaagactgacggcatgcatacacgctagcgacagacccttcccgcagcaagcggggagggtctgttcatatgtgcagaacatgcgcgcgaaatatcaaaacaggaaatggccgctgtaatttgtgttgaattattgcaaaaaagaggcgggaactcgcgtgcggtatggccgttgggctagactcgaactttagcgtgtgtttttcgtgatacgccaagagcgtacagttatggagggaacccaaggtgaggacgttaatccaggcctttcgcaccaaggagctgaggaacaagatcctcttcgtccttggcatcatcatcatctaccgaatcggctcgttcattccaacgccgggtgtcgattacaaggtcgtgaacgactgcgtggcgaatacgaccaacaatgcggagaacttcatcggactggtgaacctgttctcgggcggtgcaatgctgcagctgtccatcttcgcattgggcgtcatgccgtacatcaccgcatcgatcgtggtgcagctgctgcgcgccgtgatcccgcgcttcgaggccctgcacaaggaggggcagtccggtgaggccaagctcacccagtacacgcgttaccttaccatcggtctcgccgtgctgcagtccacgacaatcctcgtcaccgcgcgttccggcgcgctgttcaactaccagtgcaacaatgtgatccccgacgcctccatttggaacatggtcgtcatgatcatggtgatgaccggcggcaccggcctgatcatgtggatggccgaattgatcaccgagaagggcatcggccagggcatgtcgatcctcatcttcctgtccatctgctcgggcttcctgccgcagctgtggcagatcggctggggcacgaacggcaccgacggcaattggacgaagttcgcgatcgtcaccgtcgtgctgcttgtgatcatgatcttcgtgaactacgtggagctctcgcagcgccgtattccggtgcaatacacgcgccgcatgatcggccgcaagatgtatggcggctcctccacctacctgccgctcaagatcaacatgagcggcgtgatcccgccgatcttcgcctcgtcgatcctcgcgatcccgacattgttcgcacagtttggcaacagccagcagagctgggtgcagtgggtgaacaagtacctcgccaacacgacgagcgtgtggtacatctgcctgtatgcgctgatgattgtgttcttcacgttcttctacacggagatcacgttcaacccagacgagaccgcagacaacatgaagcagttcggtggctttatcccgggcattcgcgcaggctccgccacctcgcgctacctcaagtacgtgatcaaccgactcaacaccgtcggcgcgatctacctgctgttcgtcgcattgctgccgaccgtgctcatcatggcgctcaaactcaacacgcagctgccgttcggtggcacgacgctgctgatcatcgccggcgtgggtctcgacacgctgcgtcaggcgaaggcgcagacggagcagtaccagtacgcaggcttcctgttcgagaacaccgatcacaccgagggcaaggccatcgccaaatgatgtgcaggtgtgaataatctgccattcgcagattgccgcaaaagcagaccgtgggaatctacggtctgcttttgcatatgcatggctcgccgcggcatgccgatactcctgccgtgagcacactaggctaagatatgcgatagcaaagcaaatcccaagcgaaaggaacacgatgcgactgctgattatgggacctcagggcgtcggcaagggcacacaggcgaagctgctcgccgagcactacggcattccgacgatctccaccggagacatcttccgcgcgaacatcaagaacaagacggaactgggcaagaaggtgcttgaatacacgtcgcagggattcctggtccccgacgagctcaccaacgagatcgtccgcgatcgtcttgcgcaggatgatgcgaagaatggctggatcctcgatggctacccacgcaatgtcgcccaggtgagcgcgctcgacgagattctcgagggcctcggcgagcagctcgacgccgttgtcgcgctgaccgcccccaccaatgtgctgcttgagcgcatggccaagcgcgcgaaggaggaggggcgtgccgacgacaccccggaggcgatccagaaccgtctgaacacctacgacaaggagaccacgccggtgctcgacatctaccagcagcgcggcaagctcgtcaccgtgaacggcgtgggcgagatcgatgcgatcagcgaggagatcgtcaaggcactcgatgccaagcttggctgaacaatggtgcaaatgcgtgccgtgaggtgtgtgggattggtgaacatggaataatccgcgtctcaattcggtagcatagaagacggtacgccattgaaccgggcacaaagtgttcgcccggtccgttacggaagcgaagggtacgacacgccgttgcgtgcactcttcgcttttcgtgtatactagcaagttggtgtgtcttctggcgcacctacaggtaatgctatccacgaggaaaacgggtatttatggcaaaagacggtgtgattgaagttgaaggccgagtcgtagaggctctgcccaatgcgatgttccgtgtggaactggagaataagcacatcgtgctcgccacaatttccggcaaaatgcgcaagaactacattcgtattcttccgcaggaccgtgtggtgctcgagatgagcccatacgacctcaatcgtggtcgcattacgtaccgttacaagtaaagtaacagccaaggtacaaacccaagcaaaggaataccatgaaggttagcccaagtgtgaagaggatctgcgaaaactgccgcgtgatccgtcgtcacggtcgcgtcatggtgatctgcaccaacccacgccacaagcagcgtcagggctgagcagaagcagcgacacatatcaggcactcagtcgcagttcgcgtgtatgcgtgagctgaaccccgggaacgcaggcccgggccggtagggataccgggggatcgggtgcgagacctgcggcaaacagaaggaatcgcaatggcacgtcttgccggagtcgacatcccaaatgacaagcgcatcgaggtcgcgctcacctatatcttcggtgtgggacgcacccgcgccaaggaaacccttgaggcgactggcatcaatccagacacccgcgtcaaggacctgacggatgagcagctgatcacgctgcgtgactacctcgagtcgaactataagatcgaaggcgatctgcgtcgtgaagtcgacgctgacattcgccgcaagatccagatcaacagctaccagggcatgcgccaccgcaagggcctgccggtccgcggtcagcgcacgaagaccaacgcacgcacccgcaagggcccgaagcgcacggtcgctggcaagaagaaggccaccaagtaataggtgggaattgcaggccacggtgtgacagccatcgtctgcaacacatagttcgtgaattaggaaacgaggtcaaatggcagctcaaaagcaggccgcacgcaagacccgtcgccgcgatcgcaagtcgatcccggtcggtcaggcgcacatcaagtcaacgtttaacaacaccatcatctccatcaccgatccgtccggcgcggttgtgtcctgggcgtccggtggcgatgtcggtttcaagggctcccgtaagtccacgccgtacgccgctggcatggcagccgagtccgcggcccgcaaggccatggaacacggcgtcaagaaggtcgatgttttcgtgaagggcccgggttccggtcgtgaaaccgccatccgctccctgcagtccgctggtctcgaagtcggttcgatcaccgacgtcactccacaggcattcaacggcgttcgcccaccaaagcgtcgccgcgtctgagcactagacaataccatccatccaaagccgcttgaagccagtgagtgcaccaccggctgaagctgaaaggataccacagtgcttatcgcacagcgtccgacacttaccgaggaatcgctcaaccctcagcgttcccgtttcatcatcgagccgcttgagccgggtttcggctacacgcttggcaactcgcttcgccgtactctgctcagctcgattccgggagcggcagtgacttcggtgcgtatttccggtgcgttgcatgagttcaccactctgccgggcatcgaggaagacgtcaccgagatcttgttgaacatcaagggcatcgtgctcaccagcgaatacgatgagcctgtcgtgatgtatctgcgcaaggcgggcagcggcgaggccaccgcaggggacatcaccccaccggccggtgtcaccattgccaacccggatctgcacatcgccactctcgccgaagatggcgaacttgagatcgagttcaccgtcgagcgtggccgcggatacgtcccagcccagatgaacaagcaggatggcgatgagattggccgcatcccggtcgattccatctactctccagtgctcaaggtgagctacaaggtcgaagccacccgtgttgaacagcgcaccgacttcgacaagctcattctggatgtggaaaccaagccggccatctccccgcgtgatgccgtcgcatccgcaggatccacgctggttgagctcttcggcctgtgccgtgaactcaacacgcaggccgagggtgtggaaatcgggccagccccggtggccgagcaggccgatccgggcatgtccgttccgatcgaggatctcaacctcacccagcgcagctacaactgcctgaagcgtgagggcatccacacggtcggcgagctggtgaaccacacggagcaggatctgctcgacatccgtaatttcggtatgaagtccattgacgaggtgaaggagaagctgcagtccctgggtctgtcgctcaagtcctcgccgctcggcttcgacaccaacaacctcgaaggcggcaccttcttctcgccggaagacgagtaaaccgccaacgacataaccgcttcgccgatttcggatgttcgggccactgcccacctgagttcggcgtggcaacaaggagatacaatgcctacaccaaagaaaggcccacgcctggcgtccagcccggcacatgagcgtctgatgctcgcgaacatggccaccagcctgttcgagcacggccgcatcaccaccacgctgccgaaggccaagcgccttcgtccgctggccgagcgcctgatcaccttcgccaagcgcggtgatctgcactcccgtcgccgtgtgatgcgcgtgattcgtaacaagtccgtcgtgcacaagctgttcacgcagatagctgagcagatggagcagcgcgaaggcggctacacccgcatcgtcaagatcgctccgcgtaagggcgattccgctccagccgccatcatcgagctcgtcaccgaaccggtgagcccgaagaaggcagtggtcaaggaagccgaagccgcgaccaaggtcgcagccaaggaagagcagaccgaggcagccgctgagtgaacctctgaggcatgaggaaggggccatccgtttgggtggccccttttgcatatggaaacagacctcgccggacatcggtgcgcatttgctaagctcgggttgtgacacgtttacgaatcgacttggcctataacggtgccgcgttccacggatgggcggcgcaaccaggctgccggacggtgcagggaaccgtcgaggaggccttgagaagaatcacgcgcatgccggatgccgggtccttgcggctcaccgtggccgggcgcaccgacgccggcgtgcatgccacgcatcaggtgtgccacgtcgatgttcccgaccagacactcggacaatgcgtcggccatatgaatttgacgccggtgcaggccctgcagaccaggttgtcgcgcatgatgcccgatgatatcgccatccatgggatttccgtggcgcctgccggtttcgacgcgcggttctccgcactcgaacgcacctatgtgtaccggattgccgacgcgcgcgtgccctgggacccgcggctcaaggatttcgcatggcgcaccgaccgcgaactcgacatcgcgcagatgaatgccgctgccgcacttacactggggctgcatgacttcggttcgttcgccattgcgaatccggggggcacgactattcgcgaggtgaagaccgcctactggcaacgcgtgccgacgcggccgttgctcggacccggcatgggggagcgctaccatacgcctgccgtggagtccgggctgctgtgcttcacaatcgtcgccgacgccttcgcccgcaacatggttcgctcgcttgtgggtgcctgcgtgcaggtgggcatgggcaaacgggatgtggattggttcgccggcaagatgcgtgtgccgttgcgcgagggatccactgggccgatcgcgccccaggggctcacgctcgaacacatcgcctatccggccgacgacgagctcgccgcgcgtgcggaacgaatccgtgccaagcgcacgctctagcgaatgctgaggcaccgacattgaatccgaataatcgtgccggtttcgcgcgtcgttgtgcttctcggccctattcctctgcgtaattggggacgtctgctgcgtgtgagtgtctccttttacgcaggctgttgatggtgcacgataggcaggcagggaaagaaaaagcccgcggcaaggtgcgggctgaaggcggatgaggcgagattcgaactcgcggagggggttgccctcacacgctttcgaggcgtgctccttagaccgctcggacactcatccatgtacttgccgaaacaagcaacttgttcattatgccacaccgtgccaacaagtcaaatccggtatgtcgttttccgcatgtcactgcacaggccttgttcaggaggcgaacagcgcatagtcagcgcttgggtaccccagaccgaacgcggtgacggcatgcgtggcgatgagcagggacagctgcagtagcgcgtccgacgattgcgactgtgcggtggcgatgtcggatgcgggcaggtcgtcgatgcgctgcagttgctcgcgcgcgcaatccatttcgacaatcgccggggtgcgggtgcgcaatccggtcgcaggatcggttgcgttcacctccgatgtggtgagcatgcgggtgtcgtagaccttgcggcgaatgtcctgcgcgcctttcgacagcatggtcaggcgtgctgcggcctccttgtgattgtcgctcatggtgagcagcgtggcattcgaggccagtctgcgcacgaattcggcgtcggaggaggtgttggcggaagtgggtgtgaaactgtcgtagcgtccggcgagcacttcggcggcgaaaccggcgcgatcctcggcaagcgcaatcgtagccagcgcctcacccggcagatcaagcgaatcgacggtgtcgagcttcgtcactgtgagcggcgcatacgcaaaaccgaagtgattcgcggcaagacgagtgaaatgctgtgcctgggcgctgcgcatcgtggcgtcgccgaattgggacgggcactgcaatgccacattgagccagtcatgctgggcgagtgaagcggtgaaataccgcagatagagcgggatattcgcgtcgcccatcgtgttggaatacgattgcgcggtctcgaggaaccgttcacatgtgccgagctcctgctcctgttcggagcgacctgcgattctgggggccgagcatgcggtcacgccaacaaatgcgagcgtggtgagggcaaccgccaccgtgcgtgcgcatacggaaaggaaacggtgacgtgtctgcatgaatacctagaataatagagactatgactaaatgggcttatgccttccgcgcaggaatgcgccatgccgaataactgaataactgaacagacttcaacggaggtcaccaactttgaaactcgatttgaacggaatccacgcactcgcacaggaacagggaatagatgcggagaccgtggatgccgcactgtcggaggcgctgcgactcgcctatttgaaaatgccgcatgccgcaaaatatgcccgagtcgaactcgacccgcgcgccggcagcttcaccatctgggctcgtgacgagattcctcaggaacccaccgaagacaatccgcaccccgctccggaactgggcgaggagtacgatgacaccccgcatgatttcggccgtctggcggcatccacggcacgccaggtaatccagcagctcttccgcaaggcggaggacgaccgcgtgttcggcgccttcagcggccagcgcggcaagctcatcaccggcgtggtgcagcaggacgtcaaggatcccgccaatgtgcacgttgccgtcggcgatgtggaggcactgctgccgcgtcgtgagcaggtgcccggcgaacgctaccgccatggcgaacgcattcgcgtgtatgtgacgacggtggcccgcgggctcaagggaccggagatcatcgtctcccgttcgcatccggagctcgtgcgccgcctgttcgaacgcgaggtgcccgagctggcatccggagccgtgtcgatcatggccatcgcccgcgaggcgggcgcccgtacgaagattgccgtgcgtgccaatacgccaggcatcaacccgaagggcgcgctcatcggtccaggtggttcgcgtgtgcgcgcggtgatggagaacctcggctctgagaagatcgacatcatcgactggtcggccaatccggccgagttcattgcggcggcgctctcgccggcagtggtctcggatgtgcaggtgatcagcgagaagaaccagacggccatcgcgttcatcaatgacgagcagctctcgctcgccattggcaaggagggtcagaacgcccgtctcgccgcaaagctcaccggatggaagatcggcatcgaatccaattccgcccatgccgcaaaactgcgtgaacaggcggcgaaggcggccgatgggacacagtccggcaatgccgaggagagcgccgaataggcgtttccccgacggcgttttcgcggcgctgcacatccagcgccgcgggtatgcttgcctttggtcgaaacacggtcattgcaccgtgcgaaggcgtgaaagaggtagaaacaacatggttgcacgatgagaagccatcagctcgccgtgagaacacaatagccgcgccaatacgcggctgacacacacaaaactttaggagatattgagtggcgaaagcacgcgtatacgaattggccaaggaacttggcgtagacagcaagaccgttcttgagaagctcaaggacatgggcgagtttgtcaaatccgcgtcatccacggtggaggccccggtcgtccgcaggctgaaggcggccttcccgaaggacggcggcaatgattccaggccgtcggcgaagaagagctccacacccaagtcgggtgcaccagcagcggcgaagcctgccgcgacgcccgccgcagtggccggtgcaactccggcaacggcagccccgtccgcaccgaagccgggccagcgctccaacacgagcgccaagccgggcgcccataacacccgcaggaacgagcagaccccacgtccaggccagaacggcggccagcgtggtgcgactgcgcgcccgcacgccccaggcaagccgggcgccaacgccggtggcactcgcaacggaggcaaggctgcacccactccgcatgcccctcagcacggcggcaaccgcggcggttccaacaatgcgccgaagccgggagccaatgcggcccagcatgcgccacgtccgggcaacaacccgttcagccgtaagcagggcatgcacacacccacgccgggagacatcccgcgtccgcatccgatggcacgtccgacggtcaataacaacgaacgccgtggcggaggcaatggtcgaccgggtcagcgtggaggcttccgcccacgtccgggccaaggcggcagcggtgccccgaagccgggttcctggggtcagcatcgtcagggtgcaggcagcggtggcggccgcccgggtggtaaccgtttcggtggtggcaacggcggcaacaacttccagaacaatggtcccagcaacggtccatcgcgcggtggcggccgtggtcgcggcggcgcagccggcgccttcggccgtcagggcggcaagtcctcgaaggctcgcaagaaccgtttggcgaagcgtcacgaatacgaagagctgaaagcaccggtcatcggcggtgtgcgcatccccaccggcaacggacagaccatccgtctgcgtcagggcgcctcgctggcggatctcgccgagaaaatcaacgtgaatccggcggcgctggtcaccgtgctgttccacttgggtgagatggccacggccacccagtcactcgacgaatccacgttccagatccttggcgaggaaatcggttggaacatcaagatcgtttccgccgaagaggaagacaaggagctgctccagcagttcgacatcgacctcgagagcgaggagctgcaggaggaggccgacctgaagccgcgtcctccggtggtcaccgtcatgggccacgtcgaccacggtaagacccgactgctcgacacgatccgccgcaccaacgtcgtcgcccgtgaggccggcggcatcacgcagcgcatcggtgcataccaggtcaccgtggatctcgagggtgaggaacgcaagatcacgttcctcgacaccccgggccacgaggccttcaccgccatgcgtgcccgtggcgcggaactcaccgacatcgcgatcctcgtggtggctgccgacgacggcgtgatgccgcagaccgtcgaagccatcaaccacgcgcagtcggcccatgtgccgatcgtcgtggccgtgaacaagatcgatgtgcccggtgcgaaccccgagaaggtgcgtggccagctcaccgaattcggcctcgtgccggaggagtatggcggcagcacgatgttcgtcgacatctccgccaagcagggcacgaacgtcgacaagctgctcgaagcggtgctgctcaccgccgacgccgagctcgacctgcgtgcgaacccggatatggatgcccgcggcgccactgtggaagcccgactcgacaagggccgcggtgctgtggcgaccgtgctcgtgcagtccggcacgctccacatcggcgactcgatcgtggccggtacctcgtatggtcgtgtgcgcgccatgctcgacgagaacggcaagcacatgaaggaggcgctgccgtcaacacctgtgcaggtgctcggcctcacctcggtgcccaccgcaggcgacctgttcctcgtggctccggatgaccgcgcggcacgccagatcgccgagaagcgccaggccacggaacgtgcggcccagctcgcgaagcgccgcaaggtggtttcgctcgaggagttcaagaagaagttcgccgagtccgagatcgacatgctcaacatcgtgatcaagggcgactcctccggttcggtggaggcgctcgagggctccctcatgaagatcgaggtctccgacgaggtgggcattcaggtgatccaccgcggtgttggcgccatcacgcagaacgacgtgaacctcgcctccgtcgacaaggccgtgatcatcggcttcaacgtgcgcccgaaccgccaggtggcggatctcgcggagcgcgagggcgtggagatcaagtactattcggtcatctacaaggcgatcgaagacatcgaggcgtcgctcaagggcatgctcaagccggaatacgaggaggtcaccacctcccactccgagatccgcgagatcttccgctcgtcgaagttcggcaacatcgccggcgtcatggtgctcgacggcgaggtcaagcgcggtacgaaggcccgcattctgcgcgacggcgtgaccacgttcaacgaccttgagatctcgtcgctgcgccgcttcaaggacgacgtcaagagcgtcaccgaaggctacgaggccggcatcaacctcggcaacttcaacgacatcgagatcggcgacgtcatcgagaccttcgagatgcgagagatcgagcgcaagtagtctgcaatccgcagattgcgcgcgagtaacgcaggcagacgcccatagcccacccggctacgggcgtctgccgttttcacccaatgcacatggcggttttcgactagtgttgaatagcagaaccgcataggacgtcaaacagtaaggaacaccatgcagggaaccaattctcgcgccgcccgcatcgcggcgctcatccagcgtgtgatcgcctcgaatatggaatccacgttgcacgacaagcgactcaagaacgtgacgatcaccgacgtcaaggtgaccaatgatctccagctcgccaagatctactggaccacgctgagccgggacggccatgaggagggcgaacgcaagcgcgccaaggaggcgctcaaccaggccaagggacgcctgcgcaccatggtgggcgccaaggccggtctgcgcctgaccccgcagctccagttcatcttcgacgaggtgcctggcgaggcgcatgagatcgaagacattctctcgctggcacgcaagcgcgacgaggagctcgcccgcatgcgcgcgaacgccgcctacgccggcgacgccgatccataccgccacgacgacgagaccgaggaggccgtcgaggaggaactggacgagcaggagcatgagaacaaggacgaatacaccgaatacccgggcgacgtggtggaagtggaggaattcgaggacttcgacaacagtggcgacgacctcgagcattccgacgacgaccctgtggatccggtggcgaccgacccggcatccactatcgacaccgtcgacgaccacgacgaggacaagtaaggcgtgggcaccggaaaacgcgacgcgaaggtgaacggcgtgctcattgtagacaagccgcagggcgtgaccagtcacgacatcgtggcggccgtgcgtgccgcgctgcacaccaggaaggtggggcacgccggcacgctcgacccgatggccaccggcgcgctcgtgatcggcgtgggtcatgccacacgtctgctgcagtacattgtcgagcacacgaaaacctacagcgccacgattcgcttcggccagcgcacaaccaccgatgacgccgacggcgagttcgtggagcgggaagccgaggccgccgtgctgccgacgctcgaacaggtgcgcgaagccgtggcgaacgaatacaccggcgacatcgagcagattccaaacgccgtctccgcgatcaaggtgaacggccaacgcgcctacgatctggcccgtgaaggccggcatgtcgagctcaaggcgcgccgggtgaccgtgcatgcgttcgatgtgctcggtggtcggcaaacgcaggccgcgaacggcacgccggtgctcgatgtcgacgtgcgcgtcacctgctcggcgggcacctacattcgcgcgctcgcccgcgatctcggcaatgatttccattgcggcgcgcatctgacccgcctgcgcagggaagcggtgggggcgttccgcgtgcgtgacgcccgcattgtgcgcgcgcatgccgaggcacgcaccttcgtgaaccgcgacggcgaggagatcacccgcaatcgcgcggtgctcgattgtgtgggggaagatttggccgggcatctgctcacgatggtgcaggccgcacagctcacgctgccggtgctcgccgtgagtgaagcgcaggcggcggatttgcgttttggtaggagaatcgttgcacaggcaccgaccgacgatgaacgaccggcacaccaccacggcgagcacgtgtgggccgccattgggtccgccgatggcgagcctgaggtcgtggcgattgtcgagcgcgcgaaacaccacgaattcaagccggtaacggtgttcgctgcgaatacgggaaacgaatagaggatatatggatatttttcgtttgacaccagctgcggacggcaacgtcgcatggccgacattgagcacatcgaagaaatcggtggtcacggtgggtgcgttcgacggcctgcatgtgggccaccatgccgtcatcgaggagacggtgcgccaagccaggaagctcgacgcatactcggtggtcatcatgttcgatccacgcccggcattcgtgcacgcctatgcaaaggcacatgcaggcaaagacgtgccggccggcgtgcatgatcctgaggccatcaccggcgtggacgcgcggctgcgcatgctcagccgcatgcacgtcgactatgtgctcattgtgcgctataccatcgcgttctccgagaaatcgttcagattcttcctcggccagcttgtgggcaaactcggcatgcgcatgctcgtgcttggcgaggacgcgcgcatgggcgcgaatctggaaggcgacatcaagaagattcgcacactcgccgaggccaccggcgtgttcgaactcgaagtggtgaccaatcagggcggcaccgtgcgcgtgccggaacgattcacccccacggcgccgaacgagccgggtgaacccggcgacccgctggagggactgggcaaggccgagcgacgcgcctggtcgaagaagcacaacgcgcgcgaagtgcgcaaccagagctccacgaacgtgcgatacctgctcagccaggggcgcgtgcaggcggcaaacgagattctcggccacgcgcacgccgtggaaggtgtggtggaacacggcgaggaacgcggacgaaccatcggcttcccgacggcgaacatagccgagccgatggaggggtacctgccggtggatggcgtgtatgccggctggctcgtcgatctgggacctgcagacgaatacgagcgcgaccagcagcagctgagcggcaaagccgccgatggggaggcggtagaagcggcgagcgtcaccgtaagcgataccccggtggtctcgcaccgcttctcctcatcgcgcgtcgacagccgactggctgcacaatcgccattcaggtggccggcagcgatctcgatcggcacgaaacccacctacagcgagagcaccgggctcaacgagcgcgtgctcgaggcgtatgcgctcaccgacgaatggctcgacctgtatgggcaccgtgttcgcgtggagttcgaacgcttcctgcgcccacaaatcaaattcggttccaccgacgagcttgtggccgagctcaagcacaacgtcgaggagacgaaggagctgttgggagccgaatagcggtcccgcggctaatgtcgctgcttggcgagatggaggaacgcgagggcgtctttgaggttcgtcgccggagcgagcgtcatgccctccatcttcaacggcttttgggtcgccggaacgatcgctttcgtgaaccccagccgctgcgcctcacggagacggtactccaaacgtggcaccggccgcacctgccctgtgagactgatctcgcctatggcgcagacgttcttggcgattggcttgttcaacgcggcgctcgccattgcggcggtgatggcgaggtcgcatcccggttccttcgcctgaccgcctgcgattgtggagatgtacagatcgttctgcagcaacgagatgccgccatgccggtagagcaccgccaccagcatggcgatgcggctcggatccacgccattgacggcgcggcgcggggtgggcagcaccgaattggtcacgagcgactgcacctccacggcaagggaacgatgcccatccaacgtgaacgtcacgcacgtgccctcaacgggttcgttttgcgacgagaggaacagcccggccgggtcgcgcacctcctctatgccctcgccgctcatgtcgaagcatcccacctcatcggtggggccgaagcggttcttcaccgcgcgcagcaggcgcagagcggtctgtgattcaccttcgaactgacacaccacgtcgacgagatgctcgagcgtgcgcgggccggcaatcgaaccgtccttggtcacatgacccacgagcagcaccggcacgtcaagcgatttcgcggagtctatgagcgcgctcgccacctcgcgcacctgcgtggagccgccggagatgccatcgacgtcctgcgagacaatcgtctgcgccgaatccacaatcgccagcgccggccgaaccgagtcgatcaggccgagcacggtggagagatcggtggtcgcggcgagcagcaggttctcctcgacggcgccgatgcgtgaggccctcagacgcacctgcgcctgcgactcctcgcccgagatgtacagcacgctgtcgtgtgtgccggcatgcgcgtcatgcggctccgaatcggaaccgtctggcgtgcggctatgcgcggcggctaccgatttcgcgatgttcccggcggtctcgagcaacagcgtcgatttgccgatgccgggttcgccggcgatgagcaccaccgaaccaggcactatgccgccgccgagtacacggtcgaactcgccgaagccagtggggagtcggttcaccgtgtcggtggagatgctcgtgatcggcttcgccgcgctctgcacattcggcaccgagatgggcgtgcgcgaggtgcggccaggcgccggcgtgcgtgccccggttgccgccggagcctcatggaattcctcgatggtgccccattggccgcattccgggcatcggccataccatttgccgccgctccagccacattcggtgcacacatagttcacggttttcttcgccatgccactccttatcgcctgccaacactgtatctgattccatacaacaggcatagcggcgcatgtgttccacgcagtgtttcatgcagccgctacaccgtcatgcggctgtgacaagattgcggtatggcaaacaacagcggttccaaaggcccgtcaaatgcgggaaggcgaacgtcacagtcgggggcgcggaggcagccgcagccgactcagacctccgccgtgcattcactgcgctacgtgcgcattgtggtggcggtgttcgtgatgctgttcgtgctggcactcgtctccgcattcggttggccgggttgggcggtgcgcacgccggcaaaaccggtggcagtgcccacggcgacgccctccaaggccacggtgaaggcgaaggcgttgcccggcgacgccaccgcactgctcagggcgatgcccgaccatgtttcgaatttcgcgcgcgtccaagccgattccaccgatgcatgggccgattcgaacccgattgaggaatacaagctcacctattcgaacggcaacgacaaagacgccgtgcagctcaccgtcgcccagtggagcgactcggagaaggcacaggggcagtacacgaagcttacgggtgatctcaaggggtcgtcgctggccaacggcgtcgtgaaggtgaacggcgacgtcaccggcaattacgaggtgaagacggccgagtccgacgacacgcaggccactgcagtctggcgcaacgacaccgtggtgttcagcgtgaccggtacgaagaattcggtggtctcggtctaccagctgttcccgctgtagacccagcgcgaaagtctgctcacatgtgtagactgttgcaagttgcaatctttagatatctatagaggaggcttgagatgggctctgtcatcaagaagcgccgcaagcgtatgagcaagaagaagcaccgcaaactgcttcgtaagacccgccaccagcgcaagtagtcttatactctaggctttaacaattcccgcacgcagcgatgtgtgcgggaatttcatatatgcggccgtatacgacatggggcgttcggctcccgataacagaacgaccgcgcgcttcccgcacgcggtcgttgcccggaacacaccggaatgtcttgcgaatgctcacgccttgttcggattgatgagcgtgcgcgggccgttcggatcgcccacgatgacctcgttgaccatgtcgaggaacaggccgtcttcgacgacgcccaccatgttgatgagatcctcgttgagacctgccgggtcgtcgatgcgctcgagatgcaggtcgacgacgtagttgttctcgtcggtgcgcaccggcttgccttcggcgtcaagacgcagcgtcgggttgtagccgcgttccttcatgcgctcgatcacatgcatggcgccgaacggaatgacctccaccggcagcgggaacttgccaatgacgtcgacgagcttggaggcgtcgacgatccagacgatcctgttcgagttgatcgccacgatcttctcccacaggagggccgcgccgccgcccttgatgccgttgaagttcttgtcaacctcgtcggctccgtcgatgcacaggtcgatgtggtcgacgtcgtcgatgttcacgatcttaatgccgtagccctcggcctgctcctgcgtgcggcgcgaagtggtgacgccggtgaactccagaccttcctcctgcttgcggcggccgagttcgtcgacgaggaagcgcacggtggaaccggtgccgagccccacgatcatgccacttttgaccagcttcgcggcctcgatgccggcctccttcttcattgcatcctgctgtgctttatccatgactctccttagcgagtgtgcacgttgcgttgcctatgcacgcaatctgattcccatactagaacatgcttgcgaacgctcgtgttgtctcactggcgggtttcctggccgttctcgcggcgatgcatgaggaaacgcgcattctcgagatcgaccgtgccgtcgccctgcacgagcgcgtccacttcgatgtacccgtggatgcgcctcggtgagccgtcataatacgggctcgagttcgggggaggggagagcgtcacacgcccgcttgccgccaatcccgtgggcgccagctgcatgccggccgtcgctgtgggctctcctgcgggggtgtcggtgccgtccgccgctgattccgcggcatgtgcggcggtatccgcaggggcgtcggtttctgcggaatccgccggagtccgcacgtcgccgagctcggtcagattcggctcgccgtgctcgagatcgtccacctcggcggcatgcaaccgcgtgtattcgcgttcgtccatctcgccgtcgagcagcagttgtgcatccgcaggcaccttgacatcgcgtgcgtacggcgactcgagcagcgcctgccaaccttccttcggcagatacccctcttgcgcgccggattcgcaatcgccggcgaatccgcgtgcgagatcgtccaccttctcgttgcctgcattgccggcgtgacccttaacccagcggaagctcactttgccggcccgcttgcttatctccgcatcgattgccttgatgatcggcgcgttcttcaccggttcctgtttcgagttcttccagccgttcttcttccacccgaacacccatttgctcgagcagttgatggcatactgcgagtcggattctatgaccagcggctcgcttcccgggtgtgcacgcagcgcctcgagcactgcgcacagttcgccgatctgattcgtgccgttcgtggcgccccctgccgcacaatcgcccgcatgcgcgtgttcgtcgcgcgcgccgtccgtatggtcggcccacgcccaccccatcgggccgttcggattacgcagtgcggagccatctgtggaaactgtgatcgtcatgcctccactctacgtgcgggccgctatcattgtcacgttgtgattgtgtgaggcgcacgtaatcgtggatatttctcatcatcggtctcgttgccgtttcggcgctgggttggtgtgtgcgtgttcccatgtggcgactgtattccgggctccttcggggatgcacccgtctcgagggtcgcaatcgtattggggtgccttcggttgcgtgtatgccttgagtgtcgctcttgcaatctcagtcgccttatggcatgttgtgatctgttggcggtgttgtcctttgcatgctcaatctcaacacggcatgttgtatctgtgtgcggtgtcgtctttgcaatttcgatctccaagcggcatgttgcggtttgtctgcagtatcgccatgagaccagatttgcaagcatggcattgctgcggggctctcgatgaccgacccgagatggaatctgcaaacacgacacgattgtgcgcttctcaatggtctcgtttgcagattaggtctcagcaaggcaggcgagaagtcttgcagtgactgatctgagattgagattgcgaatatggcgcgttatgccggtcgtcaatgggcggcctgagattgaatttgcaaatatgacacaactgctgcgccgcggtggtcggaacaaagatgagtttgcaaacatggcacaggcaaacgatatgactgcaggccgggcataatgcagagtgatgtgccgatgacctcgggaacgtgcatgtggcaggaacgcgtatgaaaaaacggggctccgaatcgaattcggaaccccggcgggcggatagggcgagattcgaactcgcggacgcttgcgcgtcaacggttttcaagaccgtctccttagaccgctcggacacctatccatatgcgcaggcggactcgccgcacacgactattcagtgtagcatatggctgctctttgcgtaatccgggacatgtctgagcccaatctgtctccaatcacgcagagtgtgtcgtgcgtaaagagtgtgtcgtgcgtaatcggggacaaattcagcgtgctgttgtctctttttacgcagagtgaaggcgaaggtaaaggtaaaagtacgagatatgctgggtatttcttgcgtaaaaggggatagattcgagctgcagctgtctccaatcacgcaaaaagcgggcatatgcgcccgctcgttgcgaagtatgccggcacagatcattgccggctcaggggatgctcaggcctcccacttgcgcggctcgatcacttccttgccgcccatgtacggacgcatggccttcgggatctcgatcgaaccgtcggcctgctggtggttctcgagaatcgccacaagccagcgggtggtggccaaggtgccgttgagcgtggcgacaggggaggtgccgccgtcggcaacgcgctcgcgaatgttgagtcggcgtgcctggtactgcgtgcagttcgaggtggacgtgagctcgcggtagcggccctgcgtgggaacccaggcctcgcagtcgaacttgcgtgctgccgaggaacccagatcgcccgcggccgtgtcgattacgcggtacgggacttccaccttggcgagcatctcctcctccatcgcgagaagcttctggtgctcggcatcggagttctccggcttggcatagacgaacatctccaccttgtcgaactggtggacgcgaatgatgccgctcgtgtccttgcctgcggcgcccgcctcgcgacgatagcaggagctccatccgcagtagcgcagcggaccgtcgctcaggtcgagaatctcgttctcgtgcatgccagcaagcgcgacctccgaagtgcccaccagatagtcgtcgtccggctcgcgcagacggtagatctcatcggcgtgcgagttgaggaagccggtgccgcgcatgacctccggacgcacgagcgtaggtgtgatcgcaaggatgaaaccgtgctcctgtgcctgatccaccgccatcgtgagcatggcgatctgcagacgtgccacatcgccgcgcaggaagtagaaacgggaaccggagaccttcacaccgcgcttcatatcgatgccggcgacctcctcgccgagggtgaggtggtctttcggctcgaagccctcggctgcgaaatcgcggatctgaccgaccttcctcatcaccacgtagtcgtcttcgccgccttccggcgcctgtggttccacgatgttcgacagctgccacatcgcggtggtgtactgttcgtcggcggtgtcggcgcttgctttgaacgaggcgacctgttcggagagctccttggtctgcgcgatcagcttcgccttctcatccggtgcggccttggcgacctgcttgccgatctccttctggcgggcgcgggcctcttcgaattgcttgagcgaggagcggcgttcctcgtcggcacggagcacctcgtcgacgagttcgacggattcgccgcgtttgcgttgtgattccttgactacttcaggatgttcacgaatgaattgaatatcgagcatagttcaactctaatgtgcaaagccgacagattgcagcgtttttcacgcatgttcgcgggtgcggcacgggggcggtgatccgtgtattcgccgccggtctacacaccaccgcacgtgcccgaaaggtgcatttggtaaaatcggggatgctggcctacgggaaggagcgcaatgggtgacaatcagtgggtgctgattctcgtatgcatgatcgccgctatcatcgtgatcgtgggggccgtcgtcggcattcgcatcgcgttgcacatacgtcgtgtggagacgatcaagaacgaacgccgcagggacgcggtgcattatgccttcgtaatcaacccgagcaagccgacggccggcgagacgcgcgcgtttattgagcgtttctgcacgaaccgtggcatcgccgacatcatgttcattgaaacgcagctcgacaaggacggccgcgcctgtgcgctcgaagccctcgagcagggggcggacgtggtgattgcggtgggcggcgatggcaccgtgcgcacggtcgcgagtgcgatgggcggcacgaaccatgccatgggcatcattccgatcggcacgggcaatctgttcgcccgaaacatgaacattccggtgggtgacctcgaggcggcgatgctgattgcgatctcgcatgggtcgtacaaggtcgacatcggtcgactgcagctgctcgaccacccggaagaggatcatgcgcatgccttcctaatcatcgccggcattggcttcgatgcggtgatgatcgacgacaccgaccccaagctcaagaagaacatcagttggctcgcctacttcgtggccggtgccaagcatctgttcgcccccaaataccatgcgagcgtggtgctcaccggcgcgaacggcgaccagcatgtgcgcgaggatgtcgagttccgcacgttcatgagcggcaactgcggcgagattccggtgttctcgctcatgcccgacgcctcgttcaacgacggtctgctcgatttcgaggtgatcgacacgaacggcggcatcattggctggatgaatctgttcggcgacgtggtgcaccagacgatcacgcgcaaggcccagcagagcccgctgtcggtgcattcgacgatcgaccaggtgcagggcgtgagcgccgaactgcagttggagaagccggttcccgcgcaggtggatggcgacatgctgaaaccgacccggcacatccgtttctccgtggatcacaatgcgctcatcgtgcgcgcgcccgggcaggatgccgagatgaccggcaatctgcagcccgttcgtgtggatgcgagcggcaagccaagattgcggtgatcgcaatcggtgcgaaggcgtgacatgccacaggtgtgcaaacgattgcatatcttggcgtcgttggctttctgttcggcgaatccgcggtagactggagtcagctcccgcatatgatgtgcgggatacgcaatctgaacactacagaatgaggaaagtatggttgcaaagaacgcgggacttcccgcaaccccagcggatctgatcgatgttgacgaagtggtcggcgcatactacgacgtggttccggatccgtccgttcccgagcagcgcgtgatcttcggcacctccggacaccgcggatcgtcgctcaagacgtcgttcaacgaggcgcacatcgtcgcaatctcccaggccatcgccgaataccgcaaggcagccggcgtggacggcccgctctacatcggtcgtgacacccatgccctgagcctgccggcatggaagaccgcgatcgaggtgctcgtggcgaacggcgtgactgtatgcatcgattcgcgcgacgacttcacgcccacgccggtggtctcccaggccattctcacgcacaaccgtgccgctgacggcacccagcgcttcgaaggcccgggtctggcggacggcatcgtggtgacgccttcgcacaatccgcccaccgacggcggcttcaagtacgacccggtcaccggcggcccggctccggctgacgtgaccaatgcgatcgccaaccgcgcgaacgaactgctcggcgacttccgcaacgtcaagcgcgtgccgttcgaacaggccgtcaagtccgagttcgtcaagcgtttcgactaccgcgagcactatgtggacgacctgaagaacgtcatcgacttcgatgtcattcgagactccggcgtgcgtctgggcatcgacccgctcggcggcgcctcggtgaactactggccgctcatcaacgagaagtacggtctgaacatcggcgtgatccgccctgaggtcgaccccacctggcgtttcatgacaatcgaccacgacggcaagatccgcatggatccctcgtcgcagtatgcaatgaagggcctggttgacgcgctcaatgccggtgcttgggacaagtacgacctggtgggcggcaccgaccccgacgccgaccgccatggcatcgtctgcccgaactggggcgtgatgaatccgaaccattacctggccgtctgcgttgaatacctgtttggcggcaaccgccccgactggccggagcacaccggcgtgggcaagacgctcgtctcctcctcgctcatcgaccgtgtggccgcctcgatcggcgccccggtggtggaggtgcccgtcggcttcaagtggttcgtcgacccgctgttcaccggcgagattgctttcggcggtgaggagagctccggcatgagcttcctgcggttcaacggccgtgtgtggaccaccgacaaggacggcatcattcccgacctgctggccgcggagatcaccggcaagaccggcaagaacccggcccagctgcatcaggagcaggtggaccgtttcggcgagagctggtattcgcgcatcgacacgccgaccacgctcgagcagaagcagaagttcgccaagctcgacgcctccgatgtgaccgccacgaagctcggcggcgagccgatcgagcagattctcacgaaggccccgggcaacgatgcgccgatcggcggcatcaaggtcgtcacgaaggataactggttcgctgcgcgtccttcgggcactgagaacatctacaaggtgtacgcggaatcgttcgtctcgcccgagacactcgacagcgtgctcacggaggccaccgaggtggtcgacaaggcgctcggcgagtgattccaagaccgttaggtctataaacctaataagcctataagagaaagcgggctgcagatgcacatatctgcagcccgctttctcattcggtcttaggcatgaatgcgcctgccggcatgcctcagccaatgaggccgaagaacgagctgagcaccagcgcgcacagcacgctcaccgacaggagggcgacggtggcggtatgcccggaagccatgcgcatggccgtcttcgggtattccttgtcgatgttgccggggccgtagaagaagaacatgcgcacccacatccagctgttcatgacaatgagcaccaggctgcccaaccgcagcatgctccagccgaaggagagcatggtggcctcatcggtcagcgagagcgcggccttcgcggtgaacgcgaaatagccgaggaaaccggccgcgcatatcggcagcaaaacgatgttcgtgatgatgagcactttggaaagcatggtgaaacggtgcaccacaatgtgcccgctgtcatcaacagtcttcgcctccacccgtttgcgtgagacgaatgcgcctatgcagaagacgaccgtgagcagccacgagacgagacatatcacgatgagcaccacgagcacccagactgacgatacgagaccggaggagatgttctccggtatcgcatattcctgataggggcgtgcccccgcgatgtcaggcgtcagccaatcgtcctcggtcgcgccggcggcaatcgcgttgatccaatcctcgagattgtgggtgtagtccttgtcgagcggcagtccgggcaaggagagcgaggaaccggtgcgcatctggtggttggcggcgtagtagcgcacgagcacgttcgaattgccggcggcatgggcgtcgccgatcagttggagcgcgccctgttcgatgggcatggccgggtcgatcgtaccgtagttgacgagcagcggcatcgtgagcgtatcacggtattcggctgtgttgaaatcggcatattcaaggccgatcggtgcgaagttgagactgagcaggcgcggtatgatgtcgacgacgccgcctggcgcgccgatgatgttcaggtattcagtggccgccatcgcaatctgctggcgaccggaatacacgggcgcgctcgtgagcacctggaatgcgatgtgcctatccttatgcgtcatcaccgaggcgatccatgtgccttccgattctgcgtacaggccgaccttgcgcgcgtccacgccctgctgtgcgcgcagcagattgagccctgcgaggtagtcttcggcgcttgagtcatagtcgcggcgcaacggcgtgtagttgtcgagacgcttgtcttgcacgagcgtggtgatgccggccgaggccagcgcgttcgcaagatcggcgtacacctcctccgccttgccggtgcccgcaccgtgcacgaacacgcatgccgcgcggccgctgggtgcattctcgggctcgcgcagaatcgcgttcaccgtcttgccgccggagatgggcagccgcagacgagtctgcctgacctggtaggtgccttcctgcggggtggtgatgccgcgcgctttgatcgccgtgctgcgctcggtaacctgcagatgcatgctgagcggtttcaccgaccatttcggttccatcgcgatgccaagtcctgcgaacagcgcaatcatgacgatggacacgccgaaggtccacgcaagctgtctgaaaaaatgctgcacagtaacactgtaccgattcggcagatattcctcttaccgcgacatgcgcgcctatgcgcgacgctgcgccgcctccgcctcgtccagattcgtatagcccccgagacgcaccgtgttggcgatgatctgctcggtcagattctcctgcctgcgttcgcattcccgcacgaaccgctcgtacaggtcgagcgtgcgctgcgaatatgtggccaattcgccgcgcaggtacgtttcgaacgaggtggtggtctcgctgtcctcggcggtgtcgaacacgcgcatacccgcgccaagtgcggggtaccggtcggcgaactcatgcgcccatgcgagctgtcgcttgatgatgcgttcctgctgcgcgatgcgcgcctcggataatcgcggcagatgcggttccagatcgcgcgcgtagatctcgggcgccgtcgacgccatcatgcgcgcgtatttctcggtgacgagattgcgtccgcccgcatcggcctcacgcaggtcggcaaggtagcttgtcagcagctcctgcggccatgcggcgaactggcttgcgcgcatcacctcgaacatcggccggttgccctggcagcttgcgcgtccaccttcgttgttcgtgtgctggaactggtcccattcgcgttcgatgatcgatttgatcgtctgccgtgtgctcatatcgccgccttattccttgcttcggtggattacagactgtgcaggcaggtcgccggcgacgtgatatgcgcctccacatacggccgctgccattcgaggaaggtctgcggggaatcgctcaggccgagcgcattgagtgtgtgggtgatctgttcgcagattgtctcgacgatcgcgttcactgtgtcgatgctcggtgccgcgcctttgccgccttcgccgaagcccgcgccgccgaaacaggctgcgcttgacagacgcatcagttgctcgagctcgccgcagatctcggtgagcagcatcgccgggcgtgcactcagccggcgcagtgcggcgaaccgccacttgtagtacggcgcatagcccacgctcgccgggttgttcaccaggaacaccaatgacgacgcggcatcggcgaattgctcgatgcagagccacgcagcggcgccgtcgccgcgttcgagcatacgcggcagattgtattggccggcctgcgagatcatgccaagtctgcgcgagatcaaggcgagccgcacatcgtcgggcatgcgggtgaatgattggcgtgcactggaaaatgcgccgagaccatcctggaacacgcgtccattcgtggcggccgccagcgtgctctcgtcgagcgagagccacagatgcggttcgtcgtcggccggcgcatggggcataccggtgagctgcgtgaagaacgcggcgatttcgaacacgccgtcacggcgaccctcaccctgcgcgcgtggagtggcggcggagcgtgaaacaccgtggaacatgctggggagggcgtcataatctgcctgcaggcgctcgccgaactccgcatagtcgtcagcggtgagccacaggcacacgcgcggaccgaaatcatggtcgcgggagagcgcgtcatcgaaaccgtagcattcggaaccatgacccaccagccctgcggcgatgcgatgcttgacactcgcatacctctcgtcgatcatcggtttgacgagctcctgccagtacgctttggcgagagccatgccgggttcggcgacgcggagtgcggtgccgggggcgagcgttcgcggtgacgtggaatgctgtgcggaggcctgcattgtggacggcacgctcgcattatgcaccgcagaacggtggatatcagtgtggacggtggattgtgcgggggagtcatccaccgaatcatgtggattgtcggtggattgcgtcaactcgagtttgcgctgcgcctcctggagattctgcgcggtgacccgatagtagtcggtgtgctcgccataacaccgggcgatcacgtcaagggcgcgctggtattgccgcacggcctcggcatagtcttcagaggcgaagcttacgtgggcggccccggccaatgcggatgcatagtgggcgctggagtcggaaccggcatgctggtagatgtcgagcgtgcgacgggcgagcgactgcgcctcttcgagttcggcgtcggtgggctgatcctcaccgtcgagcatagcgagggcgagattcgtgcaggtggaggcgatatccacgtcggactgggcatccacgctcgaatgttcgaggatcctcagcgattcgtggagttcatcgattgcctgccgcctgcggtgcgtctggctgaacagcatcgaccggttgttgtggagggcggcaagacggcgatcgtccggcccgtaggtgcggcgtgccgcgtcgagtgcctgttcgaacagatcctcggcctggtcgagattgccggcggcccgttgcgatgtggccgcgttgatgagcgtggtggtccaggcctcggtgccttcgaggcccatacgcagtgccagctcgatggcgcgctggatgatccactggttctcctgatgacgcccctgcgaacggtagaatcccatcgtctcgttgagcacggtgagcagacccgcatagtcctgcgcgttctcggcgtcggccatcgcctgctgcagatactcgtcggccttgtctttggcggtatgcgaggcgaacatcgcatcgagtccagcaaggaactcgtcggcgtcaaagctggtgcccgcgtttgacggactcttctccgactccttcgacgcatccgattcgctttggaattgcctgagattgccgagcatccgctcaagatcacgttgatcgtccatgccgcctcgcttccgtgaactgctaccttgcgattctaacccgtggcggcaaacctagacgatatggcggtcggcagcccatagcgtgagctcgttgcggttcgagagctgcagtttgcgcaacacgttgctcacgtgggtctccactgttttcaccgagatgaacagttcggcgcccacctccttgtaggtgtaaccgcgggcgatgagtcgcatcacctcctgctcgcgtgttgacagtgagtcgagctcggcatcgtgcgccacggtgtcgccgccggcagccgattcattggaggcgtccatgccgtcgctcagcggcgccccctggaacgcggagagcacgaatccggcgagtttcggcgagaacacggcgtatccgtcgctcacttgctcaattgaatggatcaggtcgttgccggtgattgtcttcgtcacatatccgcgcgcgcctgcacggatcaccgaacccacatcctgtgcggaatccgagaccgacagtgccaggaatgccgtctgtggggcatggggctgggacttcctcagaatctccgcgccacctccgccttcaccgcctggcacatgcacgtcgagcagcacgacgtccggctgggtgtccgcaatcatctcgatggcgctcggcacatccgccgcctgcccgacaatcgtgaaatacggctgcagcgtggcgatcacccccgcgcggaacatctcatgatcatccaccaccgctatgcgaatgccctgtcgttcccgctcgctcatcggcgccctccgtttttctcgtgcgcgttcatattcctctgattctgcagtctacccgccgcctgcattgcgtcgtcaaccgcccgtttgggctccgcttgtgtgatctgccccgtctatgtgattggcggctcggcctgcgtaatcgggcggctccacttgcgtaatgtgggacatctgcgtgccgaatctgtccctttttacgcagagatgaggtaggccggctgacgcaggctccagtttgcgtaatttgggacatctgcgcggcggtttttgtctctttttacgcagattaggtggattgggtggattgggtggattgggcaggtcgtatgggatcgcccgattgggcgggacggtcggtgggggagtccgacgtgcgcgaggagtcgaaacccgcctcaagcggcatatgcatgcgcacttcagtgccccagtcgggtctcgacacaatctccaccgtgccgccgcgccggcgcacgcgcccgatgatcgactcgcgtatgccgagccgttcgggcggaatgtcgtcgatgtcgaacccgttgccgtggtctcgcacaaacacctccacctgatgccgatccgcctcgcaatacacggagaccggttctccgccgtgcgtgacggcgttgaccatcgcctgcctcgccgcatcgagcaacgcatcggtctgcgcactcggccgcgcgtcgcccaccgtgaccacctcaatcggcttgccatgcgtgtcttccacctgtgcggcgatctcctgcagaccggcgctcaccgacctgtcgctcgtggtccgttcctggtacagccagctgcgcaactcgcgttcctgcgaccgggcgagcgtgaacacctgctgctcatcgtcggcatgcagctgaatcaaggcgagcgtctgcaatacgccgtcatgcagatgcgcggtcatgtctgcccgctcctcctcacgctctttgagcgcgcgttcctgccatatattgcgaatcagcgtcatcagcagcggaatcagcgcgcagattgccgccaccagcaacgcgaatccgcaggcgatcgccgaaccgaacggcacggcgccattcctggcgaccgtctgtgccacgaacacgaggaatgcggtgaaaataaggccttcgcccaccagcgtcagccatgcctgcccgttgcgcgcgcgcgtgttgagccacggcaggcccatgcccgccaaacacggcacaatcggcagcatctggcttcccgagaatcgcatcaccgcgttcaacccggatggcaacgcgatgagcacgacgccgattccggcgaatatggccggtttcgaggcgttcgcgagtgtgcggcgcacggagtccttggcagagggagagtctgtagactgttccaatccggtgtaggcataccaggcatcctgtgccgagtcgagcgtctgcgatacgaagagcgggctttcggattcacccacggaggcgttccccctggcaagcggtgcattgcgtgagctgtgggtgccgcgcaaccgggcagcctcggccacgggattcccctcgggaatggcaatccacagcgccacataggcgagcgcgcccacgccgaaccagcatgcgagcagtacgaacactatgcgcaccaacgccaccgacacacccagatgcatgctgatgccgcgggccacgccggcgatcacacgaccctgtttggggcgcaagagcggcagcttggcgggcagtagcgggggagcgagatgctcgggaatctgactcatggttccattgtgccgcattcaggggaggtagggggtgcctcaggtggaaatcagggtcggaatcggggtgtcccccgatgcctgagcaatccgccgtctgctgtaatggaaccatgggcaacgcaaaccacaatccacagcagccgcagggcgagaccctcggcaacggccagtccgccggccagtacggtcagcctgggcaaggccagtattctcacacctcctacaatgccaacaccacctacaacaccgactatgagaacgggcgtcccacgccgaacgccaacaacggcggcgaacgccctgaatcctcgttcttccgctggattcgcgaaagcggcgtgcagcgtacgaacaatcgcgtgatcgcaggtgtgtgcggcgccatcgcgcaggagctcggctggaacgtcacgctcgtgcgcgtgctcatggtcgtgttggcattcatgggcggcaccggcgtgttcttctacggactcgcctgggcgctgctgcccgatgaatccgacgggtcgatcctgctcgaagacctcatccatgggcactggaactggtcgttcatcggcgtgatcctatgcatcctgctttcgggcgtgttggtcgtgccgttctttggattccacggtgccgtgaacgtgatgccgattctgctttccgcactggccatgtacctcgtcatcgaccacgggcgccgccggttcatgcggccgaactccatgaatggcggcatcggtgggaacggcggcaacacgggtggctatggaggcccggcaccggctcctcccatgccgccgatgcccaatgtgggcgagcgcgccgccggcccctccatgccggcgcagcagccgggcgcctatccgaatgccgcacggtatggcatgccggcggccgccccgcagaacagcggatacacgcaatatgcgcagcccgcgcagccctttcgtggggaacgtccgaatgtgacccagccagagtcgcagtcgccggcgcagcagtccgctgacgcaggtactccaaccgtcaatatgccaccagtcgccgctggcagtgcatcggcgcaagcgttccggccagcgcaaccgcagtccgcaagccagagcgcatatcactatacctaccactacgagcccaaggactacacctatgaataccggggcgcaacgaaggcacgccgtaagcctgcagggccggcggtggtgctgctgttcctcgggctcctcattgcgggtatggcggtggtgtccctgatctgcggttccgccggcaacggctcgttcagcacattgtttggggcgtcccgcggcgcggtgctgttcatcggcggcgcatgccttgtgctcggtctcatcatcgtcgccttggggtgtgccggcaggcgcaccggtggcctgcaccccttcgcatggacgctcatgttcctcgccgtgatcgccatgtgcttcggcggtgcggtgggggccgcgaactcgctgagcccttacttggccaaggattacaagcacgtcaacgtgggcaagacgctggtgatcgactcgtcgaaggcgagcatggagacattgcgcaagggcatcgccgtgcagggcgaaggctacgcgaaatccacgctcaccatcgacctgacgaagtataccgggcacaacaaggcgaagcaggttcgtctcaacgacgggcagaccaggaccacgtactgcccagtcgagacgattccgatgacggtcaccgatgccaaggtgatggtcaagattccctacgggtgttcatggggtttcaacgtatcgtcgggcatgatgagcacgtggaattcgattgacgcccaggggggcctgctggccaccggtgtgtgcagcgaaggcgatcgaggcaacggctgggacattcaggccggccgctcgggcttccaaatctccggtgcccaccccgacggcaacggcatcagctcgtggtacagcatgactggcgacatgaacgagttgtgcgagaacgtcggggttgacgacgacatgaaccacgccgtcacgaagaacaccgacccgcgcgtcaagcagctcgccgagaacggctattactggccgtgcctcaccgacaatgcgaaaagcgtggcgcacaccgaactcaacatctcaccccgcctgctgcgcaacgcctcggtgacggtctcctacggcggcgatatcgccgacgccgcgaagaaacactgattgaaaggagcctgacatgaagaagcaatctgattccaacgacgcacagacgccgtacgacgacgaggccaccgaggtgtttgccgccgaagggccgcttgacgagaccgtggggatcgacgagcgagtcgacctcacaagcaccacgcagatgcctgctgcggatgccaccgcacctgtcgatatgaacgcacccctgtacgcgcaatttgccggggacaccgacgcggactcgggcctcggcaacgacggcggaagcgatgacggcggagccaatgccagcagtgccgaacccggtggggagcccgtcggcgatgacctgacgatcccgatgcagacgaccgatgcctcacatcaggcgagcaccggagagggcgcaccgcggaacatcccgctctaccaggcgcctccgcagtgcaaaccggagccggaacggccgaagggggcgagcgcgggcaccatcgtgttcggcgtggtcgtgctgctgttcggcgcgctcacggtcacggtcggtctgctcatgaactcgtcgatgttctcgttcgtcgagttcaaccggatcaccggttacctgttcgccggcctcggcattctgctctcgctcatcgccatcgtgatgggcgtctccagccactggcgcaacaagaatcgcggtgcgtgacagccggatgccacagacgttcccacacacccaccagaaaggagcccaagcgtaagatcatattctcaatctcctagcatcttcacttgaaacccgctgtagatgcgctctatagcgggtttttcgttgcgatcccgcgtatttgcagactcctataacctgcgcgtataaccacgccggcattcgtgcgtctgaacggcgatacagtggcgcccgtgcctgacaacgacggatgcgggcacgacccagaccaatagcacacagacaatccatgctgtacaggaggtgccatgacccagctgaacaccaaactcgtccacggcgtaccggtgacggacaacgctaccggcgcggtgaacccgcccatctacaattcgtccacctatgccttcgaatcggtcgggtctatgccacgctgggactatgcgcgcagcggcaatcccacgcgcgatttcctggaacggcagatcgcccagctcgaacacggtgtgcgcggtttcgccttcgcctcagggctcgcggcgatccatgcagtgctgtcgatcttcgcaccgggcgagcgcattgtggtcggctcgaacatctacggcggcacctactcgctgttcaacgagcatttcaaccgttgggggctcgtcagctacccggtggacacacaggacctgcgcgagctggagcatgcgatcggcggacacggcgagcaggccccggcgaaggcggtctatttcgagacgctcacgaacccgttgctgcaggtcaacgacgtgcacgccatcgccgagatcgcgcacaagtacggcgccatcgtgatcgtcgacaacaccttcgtcacgccatacctgcagcagccgctcgatctgggcgccgacatcgtgattcattccgccacgaaatacctcgccggccattcagacgtcgtcgccggtctcgtggcggtggccaacgacattctcgcagcccgcgtgtactactcgcagaacagactcggcggcgtgctcgcccccgcggaatgcgatgcggtgcgccgtgggatccagacgctcgcactgcgcctcgaacgccagcaggagaatgcgctcgccgttgcgcgccatctcgatgagcacgccgccgttgcgcgcgtgcattatccgggcctgcacggcgaggcggtggcatcgaagggactgcggggcgccggcggcgtgctcagcttcgaggtgcgtgaaggggtgaatccggcggatgtgctgaacaatctgcagacattccgtttggccgtctcgcttggcgccgtggaaagcctggccgaataccccgcgcgcatgacccatttcgaactgccgcgcagcgaacggctcaaagtgggcgtcaccgacgagctgatccggctggccgtgggcatcgaggacgtacgcgatctgatcgaagacctcgaccaggcgctcgccatcgccaccggccacgcgcaggcgccgcaatcgctcgagctcgcgtcgctcttccgttaaccgttccctcgcgcatatgactgcgccactgacagactggcttaccatggcccatttctccacgctggccatccacgccggctatgattccgcggactgtaccaacggcgatgccgcagtgccaccgatctacctttccgccgccttcgacatgcagtccgcggcacacggcgacgcgctctcggcaggtgccgcagagggcttctcatactcccgtatggccaatccgacactcgacgtgctcgaacgacgcatcgccgcattggagggcggccgttccgccgtggccttcgcctccggcatgacggcggtctccgcggcgttgctgtgcgcggcggaaggcggaggtcgcatcatcgccgcgcggaatctgtacggcgcctccgtcgatgcgatggacagcctgttccccgaattcggcatcgagaccgattttgtggatgacatcaacgaccttgccttggtggagtcgctgatcgggccggacacgcgcgcgatcttcgccgggtccgtcgcgaacccgtccaccgaggtcgccgatgtcgccgcgctcgccagcgtcgcgcatcggcatggcatcccgctcatcatcgacaacacggtacccacgccctacctgttccggccgatcgaactgggggccgacgtcgtcgtgcattcgaccacgaattcgaagtggatggcggccgtgagcaggtcgcgcggattctcgatggcacccacgtgttcacctatgtgccgaacataggcgatgcgcgctcgctcatcgtcgatcccgcgcgcatcacacaccgcgaggtctcgccggagttccgccggatgagcggcgtggacgacaatctgatccgcctgtcaatcggattggaggacacggccgacctcatcgccgatctggagcaggcgatacgccgcgcctactgagctcaggctggacatacgggaaatggaataaggggttgcctccatacggagacaacccctttcgcgtcgggctggcgagatttgaactcgcggcctcttcgtcccgaacgaagcgcgctaccaagctgcgccacagcccgatgttgcttttgcgcaacagaacgttactgtacgacgtttggtcgactatggcaattcgtcggcgtgttgcatatgatcgattacgcggaagcttccgagaagcgcactgttttcggtactttcgcagtctgtttcacggaagcttccgtatgtcgtggcatgcgcgcgttcgctcagggaggccgggcgggggagtgtagcgagtctttattagactgttgcgctatgactgaagcgaatgaatctgcagacatcactgtggaagaagaggtagtggccgcccccgagatgagcaccgtggaacgcgcggaaatgctgctcaaccaggacgaggcgattttcaagcgcgtgcaggagggcgcctcgctcgacgaggccgtggatccgtcgaacaaggaattcggaccgctcgcgcacccggagcaggtgcagacccgtgtggccaagcgtgcgatgatgatcaaggacggtatcaatccgtacccggtgaatctcgacgtcaccacgaccatcgacgccgtgcgtgtcaagtatgacggcaagctcgaagcgggcgccgagaccgacgacatcgtcggcgtggcgggccgcgtgctgttcattcgcaatgcgggcggactgtgcttcgtgcagctcgccgccggcgatggcacgacgatccaggccatgctctcgaagaagcagatcggcgcggattcgctcaagcagttcaagcagctggtggatctgggcgaccacctgttcgtcaaaggtcgtgtgatcgcatcgaagaccggcgagctgtcgatcttcgccgatgagtgggccatcgccgccaaggcgctgcagccgctgccgacgctgcataaggaactcaacgaagacacccgcacgcgcaagccgtacatcggcatgatcgccgacgagaagattcgcaacatggtgcgcaatcgttcccgtgcggtcgcctcgctgcgccgcaccttcgacgaacacggattcctcgaggtggagactccgatgctgcagaccattcacggtggtgccgcggctcgtccgttcaccacgcatatgaacgccttcgaccttgatctctacctgcgcatcgcgcccgagctcttcctcaagcgctgcctcgtgggtggcatcgagaaggtgttcgagatcaaccgcgacttccgcaacgagggcgtggacgccacgcacgcgccggaattcacgatggtcgaggcttatgaggcctacggcaactacgacacgatcgccaagctcgtcaaggagctgatccagaagaccgccatcgacgtgttcggctccaccaaggtgacgctgctcgacggcaccgagtacgacttcggcggcgaatggaagacgatgagcatgtacgactcgctgtcggaggcgctcggccagcagatcacgccggagaccagcgttgaggagctcggtgcgatcgccgaccgtctgggcgtggagcgcgacgaggtggagaaccacggcaagctcgtcgaacacctgtgggagcacttctacgaagacaagctgtacgagccgaccttcgtgcgcgacttcccggtggagacctcgccgcttgtcaaggcgcaccgcagcaagcccggcgtggtggagaagtgggacctctacgtgcgcggcttcgagctcgcgaccggctactccgagctcaacgacccgatcgtgcagcgtgagcgcttcgtggcacaggccaaggatgctctcgccggtgacgaggaggcctgcgacatcgatgaggacttcctcgaggcgctcggcgtcggcatgccgccggcaggtggcatgggcatgggcatcgaccgtctgctcatcgcgctcaccggcgccacgatccgcgagacgatcacgttcccgctggtcaagccgctcaacaactgagccgtgcattcgctgaaggccgcctgtactctggaaattatctccacagattataaggcggccttttccatgccgtcgtaatctcttcgggtatgatgggcctcatgttgaaatgactgccatcgcagtcggaacatgtaaggaccgaatatgaatccaaacgagaacaatggcgcgcagccgtcgaacgacctgccgccgtatgcccagccgacgccggccccgcagccggcacagggctcgccgtccccccaagggcagcagcctgcgtatgccaacgcacagtcggcaccacaacagccgcaatccgtgtcgcagacgccgcacgacgcaccccaattcgcacagaacaccccgcagggtgcgccggctggcacgaccacagtggatatgaaggaatcggtgaacaagttcgcggacgcgctcggcaagcagcatctgaagatcggcaaccatgaggtggcctacggcaatctggtgaccgtcgtcggcgcgctccttgcgatcatcggcgtgttcctgccgtttgcaagcatcagtgccttcggtgtctctatgtctgtgtcgctcatgccacatggcgatgggtggatcctgctcatcggcgccgtcgtgatcgccgtgctcgccgtgttgcggcaggagatcgcggcactgaccgtcacgatcatctacacgctgctcgtcatctacgagatcgccgccgccggcagcaagatctcccagtcagggtacggcacgctcctccaattgagctatggcgccggcatgtggctgctcatcattgcgatcatcgtcatgctcatcggcaccatcttcgcgttctacaacaaacagcgtgccaagaacgcccagaatggtgcgccggcgatgcctgtgcagaatccggcatacgacgcttcgtaccaggacaacggctggcagttcggcgttcccgcccagagtgatccgagcaatgtcgacaatagccagtggcagttcggtgtcgagaatccgcccgccgatgcgggcgtacaacaaggcacgcctgtggcaccggccccgaatgcggctgcaccggttccgccggcagtggcccatgagccattcaatgctgcgccggacgcctctgcaactccggcggcacccgctgcaccggcagcgcctgccgcgccggctcaacccaccattcctcccgcatcgcaagatccggattcacaggacgcgcagtaatcctcctgtacggtgtcatcgggcatcgcacaggacatttcgaggccccttcaggtaaatcacctggaggggtctatttatattctccgcctatatttccgcccatcgtatttcctgccactccagcggtcattcggcgcatatcgccgcaatctggccattggggaacgtgtttcatcggccattgtccgcatccgcaactcatctggccgttgggaggggatatcggatgccaaatggcggcgtcgtattgaatctgtcggcctcctcgtgacctcctgcgcagtttgaccagcgaacgacgttgttcgatggtcggatttcgcgattcggcgcattctggccgttcggggcgccggccaccgacatgaaccaagtggtgcagattgtgggaaaggcaagtgtggcaaacgcatgaggcggcaatgaattggtgtgcagttcaatacaaactgtctaataagaaatactgtgtcgtgaggtcgtggcttcggcggtgcccttcgttggctctgtgcggacatggtatgccgtgatgtggaatacgtgtcggcgggcacagatgcctgtgccacatatcatctggtgctcagggcgcatggggcagagggcggtggcgtgggttttaagaaaatagagttcggaaaatatgctgtttttgccttttaatattccgctcaagggctatctgcctcaagggtaaacaaaatgaggccgcgtctccggctccctatgctgttgcttagttccaacaaaggggatgcaatggcattgaccagcgaacagcaacagatcgtggacaaggccacgctcacgaggatcaacggatggcagtacctgaccgttgagggaagcccgtacgagatcggcttcgagcacggctacctgctcaccgacgagtttaaggacgccattcgcgtctacacgcatatgacgctcgagacgcttggcatggattactcgttcttcgtcgatcaggcggtcaaactgcacaaggacaagattccacaggaatacatcgaggagatgcagggcatggccgacggcttcaccgccggcggcttcgagaccagcctggacgacgtcatcggctggaacgactggatggaactcaccgggtactggtggccgcaggtcgccgccgagtattcgaacaacccgccggacggccccaagggatcgcactgctcgggcttcgtggccaccggcagtgccacgaaggacggcaagccggtcatagcccacgagagcttcgacgacttctggagcggtcagtacttcaacgtgtgcgagagcgtgaagcccgcccacggcaacagcttcaagatgcagacggtgcccggctacatcgattcgatgaccgacttctatgtgacttcggccggtctggccatcaccgagacgacgatcgccggattcgtcggctacgacgtggacggcatccccgaattcgtccgcgcccgcaaggcgacccagtacgcgaacagcatcgacgaatgggtcacgatcgtcaacgagggcaacaacggcggctacgccaacatctggctgctcgccgacgccaacacgaacgagatcgcccgctacgagcagggcctcaagcaccaggagctgctgcgcacgaaggacggctcgttctatgggtgcaacgcctgccacaatccgcgcattcgcaacctcgaatgcgtcgacaacggctacaacgacacccgccagcagaccggcgcccgccgcgcacgcttcgaacagctgctgccgcagctgcacggcaccatcgacgacgatgtggccaaacgaatccttgccgacaagttcgacccatatctgggttatgtcaacgcaagctcgcgcaacatctgcgcacactacgacgttgacccccagtactatgcggacgatccgcacggtgtgtggaacgtgccgttcttcccgggcggttcctgcgacggcaagtgcgccaacggcgacgacatcaaggccctgcacatgtggggcatcttcggccgcgccgatggcgagccgttcgacgccgacgaattcatgaggcagcacccgcaatggagctggcagaaggggtatctgtacgaccgccccagccagccctggacgttgttcgactgatcgcgcaccagcattgccccgggtccgcgcatatccgcgcgctccccggcgcatggtccatgcaccggtatggtgcatatgcaatacacacgtacacccgattcgtgcagatgccccgtcgcaccgcatgtgccatgcatggcgttgcccgccagcaacccgtgcgaaccggatggcatgacaacaaccaacaatgaaggtcaatatactatggaattgacaaagcaagacctgtcgcaaatggcggaggcatacaagaaggacgccgcccagcagatcgcggagcaagcggtcaagaacaacggcatccatgcgtccagcgagcgtgagcatgtggtcgtgaccgagaacaacttcgtgttctcggtggacgtcgacagcgaggccgtggcgaaccaacgccagtccggccgctgctggatgttctcggcgctcaacttcctgcgtttccacatggagaagagcctcaagttgccgaagggcagcttccagctctcgcagaactacaacttcttctatgacaagctagagaagtcgaacttcttcatggagaacatcatcaagtacgcaggctccgatctcaacgaccgccgtgtcgacttcctgctcgccaccccgcagcaggacggcggcgacttcgacccgatctgcgcgctcatcgagaagtacggcgtggtgccgctggaggccatgcccgacaccgcggtgaccaagaacacgtcggaattcaacgccgtgctcaaccgcgtgctgcgtgaggacgcgttcaagctgcgcaagctcgtgcgcgaaggcaagtcggagaaggaagtagacgacgcacgtcgtgccatgctctccgagatctaccgcatcctgtgtgtgagcttcggcgaaccgccgaagaccgtggacttcgaataccgtgacaccgacaagaagtaccacgccgaccgtggtctgaccccgctcgagttctacaagaagtacctcggcgatgtcaagctcgaagattacgtaggcgtgatgaacctgcctgtggaaggcatggaatacggcaagatgtacacgatcgacatgaccggtgaggtgctgggctccaagcgcaagctgcactatgtgaacgtgccgatcgacgtgatgaaggaagcgacgatcaagcagctcaaggccggcgaaccggtgtggttcggctgcgatgtgctgcaggactccgacttcgtcaagggcattctctcgctcaacctctacgacgtgcagaagatgttcggcatcaagttcgacatggacaagggcgaacgcttccagtacaaccagagcttgccgacgcatgcgatgaccatggccggcgtcgacctcgacgccgacggcaagccgatccgctggaaggtggagaactcgtggggcaccaccgcgcatggcaagccggtcggtcaccagggctacttcatcatggatgattcgtggttcgaccagtacatgtacgaggtggcggtgcgcaaggagtacctgcccgaggagtaccagaaggcgctggagaccgagcctgaagtgcttccgtattggaacaccttcaacccggagccgtgatacgcgagacccgaaggggccccgtccgtaatcgatagcgttgcagatgccgctcggccaatcccgggcggctcctgtgcgcatggacgtaagccaggaaaacatgagtgataaaacgaaatccaaatccggcgccatagtcaagggcgccaagggaagcaccggcaacctcacgacgatcgcgttgatcatgatgaacgtcacggtgatcgcaggtctcgccaacgacgtgcagcagtcgttctacggcctctcctcagttaccttcttcctgctcggcggactgctgttcttcctgccgacgggtcttgtggcggccgaactcgcatccggctggagccagcgcggcggcatcttccgctgggtcggcgaaggcatcggcgtgttccccgcggtctcctgcctgttgattctgtggttccagaccacgttcaccttcggctccggcattccgtcgatgtcggccacgatcggcttcttcaccacgaagtacgactgggccgtcgacttcgccaagaactcgcatacgtggaaggtgacgctgccgatcatgatcggctggctcgcctactactggttctgctgcttcctcgccacgaagggcgtgaagaccttcagcaagatcgcgcagtacggcgtcattctcggcaccttcctgccgctgggcgtcatgaccatcctggccgttgtctggctatgccagggccacacgcccgccatcgacatggcaccgagcgcattggtgccgaagtgggagggcatgtcgaccctcgcgttggccgccggcgtgttcttctccttcgcgggcatcgatatgaacgccgcgcacatcaaggacctgaagaagccgaacaagcagttcccgctggccatcttcgtctcgatgatcctcgcgctgctcatcttcatcgtcggcacgctgatcatcgccatggtgattccgaacaagcagatcaacctgctgtacacgctgttcgccacctaccgcgcactcggtgcgacgatcggcttccctgacctctacttggtattctgctggctcggcatgctcaacagcttcgctgcgctcatcacgaacctcgccggcccgtcctacatgctcggccaggccggacgttcgggcttcctgccgaagttcctgcagaacaacaacaagcacggcatgccgagccgcctgatgtacatgcagatggcgctcatgacgatcatcgcgttcatcgtgttcctgctgccgaacgtcgaaggcttcgtcgccctcatcacgcaggcgatcacgatcctgtacctcacctactacgtgctcatgttcgtcgcgttcctgcgcctgcgttaccagcagccgaaccgtccgcgtggcttcaaggtgccaggcggcatgttcggtgcgtggcttgtggccggcattggcatccttgcctccgtgttcggcatcgtgctggcgttctacccgccggcacagcttgccgccgaggtcggctccggtgccacttatgatctgatcatcattggattgctcgcattcgtgttcattgcatgcgtgctcatctaccgtgcctcccgcaagcacgattgggctgatcccaccaaccagttcgccccgttcacctggcagatcgaagggttgaagaagccttccaaggcgctgtcgaacattcctaccgcattgctttccgaaggtcagaacccaatgggcctgccgatcaagaagcactacgacaaggatgagatgatgaaggagctgcccacgggcaaggatccgaagcagggtgaggtggcggctgcgctgctcaagaagcagggcatcaccgaaccgtccgagccggccaaggtcgccttggtgggagaccccaccgtgggcgtcaagacggtgtcgtacgaacctgaacccgtgcatacgaacgaatcgggcgatatgattcctcagcccaccgctgccgatgtctcagcggctccagtgcccaccgatgcggcggccgatgctcgccgtgccgaggccgaggccaagattgccagccaagatgcccatgagtaccacaacgaggccgtggcccttaccgatgaggcgaaggacgatgcgacgttgtcgcaggacgcccaccacgttcaggtggacgaggccgaggcgcatgaggcacaggccgcagtcaaatccatcgactccatcaacgcggatcaggccgtcgacccgaccaagcctgaggacgatccgtcgcagcccaagcactgagctcaggcgttcctaatgcgcaggcggcctcgtgacattcacggggccgcgcatgcgccaaattcttcggtgcgcggggcattcctcccatgcactatacaagctaaggagtattccatggcagacaatacagaagcaatcaagaacgaagccggcaacggcgagcagaagaagccgctcgagccgctgccgcagacggccacgaagcagtacacgtggaccggcgccgacggcacgaagatcaactacaccgccaccgcggaaatgattccggtgcgcgccaacgacggccagctcatcggccacatgttcatgttctcccaggtttccgatcaggaagacaagtcggatcgtccggtgacgttctgctggaacggcggccccggtggcgcctcgtacatggtcaacatcggtggcatgggcgccaagcgcgtcaagaccgatggcatggcgcacctgaagggcgtcggtgaggtcgaagacaacccgtattcgctgctgccgagctcggatctcgtgttcatcgatgcgttcggcactggctactcgcatgtggatccgaactacgacgccaagaaggtgtggggtgtcgacggtgacggcgatgccttcacgcgcggcatcatcgcatggctcaccaagtacgaccgcatgaacagcccgcactacctgtacggcgaatcctacggcaccatgcgcaacgccgtcgtctaccgcatgctcggcgagcatggcgtcggcgtcgcaggcatcaccgaacagtccaccattctcgactacgagcccacgctctccggtgaggacgactactacatgggcatgttccccgtgtacgccgccaccgccaactacttcaagaaggccggggtgggcgtcgaccagtatgagtggtacgacaaggcgttcgactatgcgaacaacacgcttgcccgtgccctgacgctcgccgatgcattgccggcggacgagatgaagaagatcgccggcgagatgagcgagttcatcggtctgcctgctgactttatcgaggagaagggcctgcgcatcgaactcgacacgttccgcaagaacctgctcaaggccgagggcgagaccaccggccgttacgacacccgcttcaccacgtacggataccaggacgtgcagggcgacaacgagttcttcgccggcgaggatccgtcgtacgacgcaatcaacgccgcctacctcgacgtgtacatgaagatgctcggcgacatgggcttcaagggctacgagaactacgagggcctctcgctcaaggtcaactcgagctggaactggacgcatcaggctccaggcaccatgggttccccgcaggttccgaatgtggcctacgaccttgccaccgcgctgcgtcgcaacccgacgagccgcatctgcgtgctcggcggcatccacgacgcagcgacgccgtactggaacgtgcgccacgacatcaacaagctgttcctgccgcaggcgctcaaggatcgcatcgagtaccatctgcactccaacggccacatgctgtactgcgacgaggtggctctggctgcgaccggccccgaacttgccgccttctacgacaagcgacatgaagacaaggactgatttgtccggcgcgtccgacgccaaggaaccgcagtagttgatctaagggtctgattcgaggggattgcccgcctcccattgaagaggagggcaatcccttcgggatttttgcgtaccgcacagtgccgttccaacgcaggacgacagaactatagtcgaaaattgaaatagtacggaagagattttccaggaagggaaggagcctcacatgaccgctgcaacgaagtcacagggaaccccagctccaaacaatacgggtgcgggcggtccggtcaccgtcaagcgcacactctcggtattcgacctcgtggtgttcggcatgatcttcatggtgccaattgccccgttttccattctcgcatcggttgcgaacacgtcgcacggcatgccggccctcgcatacgtgatcgccatggtcgcgatgctgttcaccgcgttctcgttcgacctcatggtgccccgctacccgtcgagcggcagcatcttcgtctacgcttccgatgagatcaatggcccggtgggattcgtggtcggttggctcatgctgttgcagtacttgatcacgccggccgtcatgctcatcatggccggcctggcaattcatgaatacgtgccggccgttccagtgtgggcatggtgcctcatcttcctcgccatcatcacggtcatcgcgatgcgtggcgccggcgccaccgtcatggtggacaagctcgccttggtggccgagctcatcgtgctgctgctgttcttcatcttcggcgttatctatgtggcgaagaaccccagcgtggcccacttctccttcgaaggcttctacaatccgggccacttcgagatgggcgctgtgatgagcgccgtctcgctgtgcgcgctgtcgttcgtcggcttcggctccgtggtcacgctcgacgatcagagcctcgaccccaagcatggcccgtcgcgcgcgatgatcgtgatcgtgctcattctgggcgcgctctacatggcgatgagcctgctgacgatgtgcatggatccgagcggcaagctcatggcggccaatccgaacaacggtttctacttggtggccggccttgccggaaagtggcttggcgtactgtgcgccgtggccaatgcgctcgcgctcggcattttcacctcgctgtcgggcatgaccgccggcgcctcgctgctgcgcgtgatggccaaggacgacgcattgccgtcggtcttcgccaagatcagcccgaagacccgcgtggccaccgtcgccaccggcttcgtcgccgtcctcacgctggcgctcatcttcattgtgctgcccatcggtatgaccaccggcgcgaagatctccaactacggcgcgctctccacgtacttcatgctcaacatcgccgtcatctggggcctgggcatcaaggcgaaaatcctcgaacatggcaagttctggcgtacgatcatcttcccgctcatcggcgcaatcgtcaccggcgtcatcttctgctcgctcggcggcgaggtgctcattgtgggcaccgtgtggctcgtgctcggcatcatcttctactacgtgtggacgaaggcgctacatcacacgccggatctgctctccgactcccgtgccaagggcgagaccaaggcgcaacgcatcgcccgcaatgcacaggccgatgcccatgccaagcaggtcgcccagaacgtgctcgaccagcagactgccgcggactccatgtcgaacgagtcctcgaaggcctgatctgtcgccctgtgctcgaactcgcgcgcgagctcacccattatgcggtgcgctcgcgcgttcgagtattcgggcatatattcaaactatgcaatttcacgattacgtttccggcatgcgcatccccacgctcatgctcggcatcgcgcccgtgctcatcggcgtcagcgcggcgtgccgggtgattggcatgcgcggtgcggacggcttgccggcctgcggcatcctcaccgccagctcggcatgcgatgcgggcactggcagaatcatcacgctcggtctgctttgcctgctcgtcgcactcttcctgcagatcgccgtcaatttcgccaacgactactcagacggcgtgcgcggcaccgatgcccaccgtacggcggcggtacggcaatacacggtggaatctgattttcagttccttgagaacggtgcgaccgcggaagaggagcggcaggcgcgcgagctgaacgggccgacgcggctggtggccggcggcgtcactccgcgcgcggtgctcatggcggccatcgtgaatgctgtgctcgcctgcgtgtgcgggctcgcggtgatcgtgatcaccggctactggtggctcgtcttcgtgggggcgttgtgcgtgacagccgcatggttctatgtgggtggctctcatccatacggatacttcggattcggcgagctggccgccttcgtgttcttcggcccggtcgccgcgcttggcacgcagttcgtgctgtgcggtcaggtcaacgggaacggcgtgtatggtgcggtcgtcatcggcgcggtctcggcggccgtgatggcggtgaataatctgcgcgacgtgaacacggatcgtgagagcggcaaacgcacgctcgccgtacgcatcggcgcgcgcgcattcacggtgtgcctgtgcgtgctcatcgccctcgtcatgctcgccatggtgattccgtggagcgtgatgtggatccatatggattccgatctgcccaatctgagcgtgctcggcggttactgcgcagtgctcggcgaaatcgcgctcatactgctcaccgtggtcgtcgaattcaatgtggccaagcgggaataccgtagcgccatgcggaatctgtcgtggatcgcgctcgccgtcgcgctggtgttcgtcggtctcaccatgtccatctgaatgcgctgagatcgtcgcgttcgcagattatcccgccaatcgggcagatatggcaatgcacgtgcatttgactcgacgggtcgctagactagggcatatgacttacaaactggtactgctccgacatggtcagagcgaatggaacaagacaaatcagttcaccggctgggttgacgtcccgctgaccgaaaagggccgcgaggaagccaagaacggcggcaagctcatgaaggacaagggtgtgctgcccgacatcgtcttcacctcgctgctgcgccgcgccatcaacaccgcgaacatcgcgctcgatgaggccgaccgcctgtggattcccgtgaagcgcgactggcgcctcaacgagcgtcactacggtgctctgcagggcaagaacaagaccgagatccgcgaggagtacggcgacgagaagttcatgctgtggcgccgctcctacggcaccccgccgcccgagattgacccgaacgaccagtacgcgcagaacaacgacccgcgttacgccggcgacccggttccggaagccgagtgcctcgccgacgtcgtcgcccgcgtcgagccgtattgggaagccgagatcatcccggagctcaagagcggcaagaccgtgctcatcgccgcccacggcaattcgctgcgtgcgatcgtcaagatgctcgacggcctgaccgaagaggagatcgccaaggtgaacatcccgaccgcgattccgctggtctatgagctcgacgagaacttcaagccgatcaagaagggtggcgaatacctcgatcctgaggccgctgccgccggtgccgccgctgttgcggcccagggccagaagtgagcttggcggtcctccgataaccactcgtctgatcgtatgaggcgactcggtgtttttcgcgccgggtcgccttttgcgtgtctaggcgcggccatgattgcaaaggcgactatttgattcgcataatcatgctgaatcgagaccagagttgcaaagatgcccattctgtgaaatgcgagatagctgcgctgagattgaatctgcaaaagtggtcatcgtacggctctagctgtgccatgctgagatcgcagctgcaagaacgatctttctgcggcgaatttaatgaccgcctttgcaatctggggcatgtgtaggcacgcgaagtgatcttcgcatactgtgttgagagtacgcttgcaaatccggtcattcttgacctgcataaacatgtcaggatgagattgcagttgcaagagcagccatctgaatcctgtgagcatgtctggatgagcataggattgcaaaaacggccatgcacatgcaccatgttcgcagtgcgttgcagaccgcctgcggaatcgctaaaaccaagctaagagcaaaccccgtgctcagattgcgcgaacagacggacaatggacactagggcgccgaaagtcggcgcaggcaaatcttcgcgggaacgagcccgcgcaagaggaggtgccatgtactattcggcaggcaatttcgaagcgttcgcacacccgaagaagccggaaggcctcgagaacaagagcgcgtacatcatcggcacgggactggcggcgctcaccgctgcgttctatctcgtgcgcgatgcgcagatgccgggcaagaacatccacgtgttcgacaaggacgtggttcccggcggtgcgctcgatggcgcgttcatcaagggcgagggctacgtcatgcgcggtggccgcgaaatggacaatcatttcgaggtcatgtgggacgtctaccgcgatgtgccgagcatcgaagacccgaatgtgtcgatgctcgaccactactactggctcaacaaggaggacccgaactattcgaagtgccgcgccaccaaggcacgtggccacaatgcgcacaccgacaacaagttcaatctctccgacaaggggtgcatggagatcctcaagctctacctcgcctccgaggacgagctcgccaacaagaagatcaccgactacttcgacgacgaagtgctcaattcgaatttctggctgtactggcgcaccatgttcgccttcgagaactgggattccgcgctcgagatgcatcgctacatccaccggttcatccatcacatcggtggcctgcccgacttctcggcattgcggttcacgcgatacaaccagtatgagtcgatgatcctgccgctcatgaactacctcaaggcgcacgacgtgcagttccacatgggcaccgccgtcgacgacgtcaccttcgccatcagcgaccacgagaacggcccggtccgcaatgtgttcaccaatgtgtcgatggacgaggcccaacgcgcccaagcagagaacggcgcattcccgcgcaacccgtacagcacgccgaacaagaaggtcgccaagacgctggtaatcaccgacctggtgaagaacgagcgcaagacgatcgaactcaccgaggacgatttcgtgttcatcaccaacggcggcttggtggagtcgaccaccgagggcgaccagaacacgccggccggcttcgatccgacgctcaagccgggcaacggctgggacatgtggaaccgcattgccgccgtcgacccgagcttcggccacccggagaagttcatttacgatccgaacctcaccaagtggatgagcgccaccgctaccacgcttgacgacacgattccggcctacatcgagaagatcaccggacgctcgccgttcggcggtcacaccgttaccggcggcatcgtgaccgtggaggattcgaactggctgatgagctggaccgtgaaccggcagcagcagttccgcaaccagccgaaggacatgatctcggcgtggatctacggtttgttccccgacaagccgggcaactacattcgcaagccgatgcaggactgcaccggtatggagatctgcgaggaatggctctaccacatgggagtgcccgaagaacagatcgaggagctcgcgaagaaccattgcaacacggtgccggtcatgatgccgtatgtcgacgcgttcttcatgccgcgcgaactcggtgaccgccccgacgtcgtgccggacggtgccgtcaacttcgcgttcatcggccagttcgccgaggagccacgtgacacgatcttcaccacggaatattcgatgcgcaccggcatggaggccgtgtacacgttgtgcgatgtggatcgtggcgtgcctgaggtgtggaacagcgaatacgacgtgcgtgacatgctcaacgcggccgtcaagctgcgcgatggacagccgctcaccaccttcggacgcaataatgtggaacgcaaggcgattgcatttgcgctggggcgcaccaggggcacgtacatctacgacatgctcaaggtgtatggcgccatcgccgacccgaagcacccggtggatatgaagccgggcatgcggttcgacgagtcgttcaatgaagcggatgagcagcgtctgatgcagcatgccaaggaggcggaggccgaggcgttcgcgacgccgtgttccgccgatgcaccggttgccgccgacaccgtggacaccgtggacaccgtcgccccggcggctgcgcccgacggcgctctcgagccgggggagaatgattcggcgaaatgaaggcctatgtgattgagcaggcggacgaccatggtcttgacgccatcaagctcgccgaggtgccgattccggcagtgggaccggggcaggtgcttgtcaaggtgcatgcggttggtctgaatccggtggattacaagctggcggagggcggtgacccggactggtcgttcccgcatacgctgggccttgacgtggccggtgaaatcgccgccatcgggccggatgtctccgaggactggcatctgggcatgcgcgtcgccggacacatggcgacctgcgctacgatggctgcttcgccgaatacgtggcatcgccgacgtatgagctggcccgcatcccggatgacgtgagctataccgacgccgccggcctgctgtgcagcgcgttgacggcctaccagacgatcaaccgcaaaccgaatctcaacaatgtgcacacggcattgatccatggaggctccggagccgtgggcggcattgccgtccaactcgccaagatgcatggcctcacggtgttcaccacctgctccaccgccaaggtggactatgtgcgcaaacatctcgatgtggatgcggtcatcgactaccgcaaggaggatgtgaccgaacgcataggcgagctcaccgacgggctcggcgtcgatctcgtggtggacacggtgagcggcgcggaggccgagaaggacttcgaccgactggcctacaacggtcagctcgtcaccattgtgggcgtgccgaacatcgacagtgacgacatgttcggccgtggactgagcatggcggtcgtcaatctcggcggtgcgcatggctccggcgattctcggcagcagaacgatttgggcacaatggccaccgacgtgtttgagatggcatcgcagggccgtctcgatccgctcatcgagaggattctgccgttcgccgagttggtggatgggttgaagacgctcgccaccggcaaagtgaccggcaagctggtcgtttcgctcgacatctagcggctccaccgcggtttggcatggcccgcgcggcatggtgcatggagttttccgaacaccgcgccgcgcgggttcccatttgtgccccgttttacggatgcttccgaaagatgtgccgcgagagggcctatctgcggcacggttttcggaagcatccgtccgaaataccgccgcccacgcagccgccgtcgcctagaacggcgtggaggccaccaaatacttgccctgaggctcgccttcgccgtcgatcacggcctcgacatgcgcccatccgtcgctcgccggcacgaacacggcgtctccctgatgcagtacgcgtgaatccgcttcgctgatcacctgcaccgacccttgtgtgcacaccaccacacgagggccggaatgcgggaacggcgtatgcccgctgatctgcctcaccagtgagtcgtagcgtttggccagcgcgttgatcaccggccagggctcatgctgcacatccacctgcccgtaggcgagcatgtactcgctcacgttcggtttgtagaaggcgaggtcgcgcatcagcatcgtggcgatctgcgagttcgacggatccaccggcgtgctggtgcggcagtccaggcattgcagcagattcacgatgtctttgtgcttcacggtgagtcctgcgcgcagcacgttgtccgaattcgtcatgatctctgctgccgtaccatatatataggcgtgtggggtgccggtgggcaggaacaccgactggccctcctcaagcctcaccgggttcatcatgagcagtgcgagcgagctcgtgtctcccgggaacgccttggccgcgcgaatcgcgaagtcgaatgcgagatcgttgcgcgtgtgttcggtgagtgagcgcgcatgctgcagatcgtcgaggagttcctgcggatccgtttcctgcgccgtgatcgccgcatggaatgcgcggaacagtcgttttctcgccggtgaccatacggcggaggcgatgggcatcatctcgtccgccatgacaaatgattcgcctgccgactgcgtggcggtcgagttgagcgcctccaccatgcgttgcgccaccggcagcctgagcaattccagattccgtagcgcgaatgtgcgcgtggagaatcccactgccgcgaggaatggttcgagtgccaccaccatctcgcttttcgcattgatgtctttgaacgaacgttcgggagcgttgagtggtatgcctgcgcggttctcctcgttgaaccccgcgcgcgcctgaaaggccaccgggtgcacctgcagcgagagcggttcggtggcgcagatcagtttgaacagataggggagcaccgggccgaattcctccgagccgcgccgacccaccatgtcaatgggattgcgctcgatcatcgacgtgagcggctgttcgacgccatccaccattatcggcgacggcgactgggcatgcccgctgaaccacatctcggcaagcggctgctgtgtttcgtgttcatccaaatggaacacatgctgcagtgttcggtgcgagccccaggcatagtgtttgggaacagggcgaatagcgtacactgcctgctcccttctgacttggcgtttttcggcgctcgcgcatacgtgcatattgtacgcgaattcgcatgcttgtgcccacatgggaagatttttcccacattcagggctcgattggctggttatttccactgctacacacctgtgattacagtgggccatatgaaaatcgctccgatctatgacccgacccagcgccgtcccagccccaaaccggtgcaggtcgatctacgcaaggcgttcatcataggcatctgctgctgggtcgtcgcgctgatcgtgagcattgtcgtcttctccaccgcacattcggagatgtcgcgccagtcgatgttcatctgctcgtatggcgtgttgattggtttcgcattgcttgtgtgggagcattttcaccgtcgcgattaccgtcggctcggcgccgactgatttcgccggcctcctctgcagactcgggcacgagcggtagcaccagactgaatgtgctgccctgcccaggtctgctccacacctgcacattgccgtggtgcatgatggccacatgcttgacgatggccaggccgaggccgacgcccgactgcgtgcgctcgttctggttcgctccgcggtagaaccgttcgaagatgcgcggctgctccttgagcgggattcccgttccgcggtccaccacgcgcaccaacgcatccttggtgtcgcgcgtcgtttcgatgagcacgctcacgttcgcgttgtcgggcgagtattcgatggcgttgtcgacgagcttgccgatcgctgcacgaatcgccgtggcgttgccgcgcactttcggctcgcccttgccggtgatggacaccgtgatgccgcgttgacgggcttgcggcaagagttcgttgaccgccacctccacttgttcgcgcacatccaacaccgcggattgcgcgttcggagcatcgccctgtgccttgatgagcagcagcagattcttgaccatgtgatcgacgtaggcgcttgaccgacgcacgtcgcgggccgcctgcgcgacctgttcggggctcatgccgccgtgttcgagcacgtcggccagccgttgcagatcctcactcggccgaatgatcatctcgctcacgttcgtcacgaagtcgtcgcgcatctgcgagaaccgcaccgattccgagatgtcgtcgatgagcacgacgacgaattgctcgtcgatgcgcccgatgaccagtttgagccagttggggcgcgagacggtgctggttttcaggtcctcctcagtatccaccggttcgggcaacgcgaaacgtttcggtgtggaggtggtgatctccagcgacgtcttgccgccgtgctcgcgtactttgcgcacggcgtcgagcacgcgcgaatccacgatcacgtcgtcgttgacgatgcccagacggtaggccgccggattggcgcgcaccacgtcgtcggaatcgtcgaccacaatcgatgcggccggaaggatcgacaacaacgcggcggcctcatcgtcaagctcgtcatcgtcatcgtcgtcgccgtcctcatcgtcacgcgagcgtcggcgccggagtctggagacgaggtcgccgatggaatcgggaagcgagacgccgtgtgtagtgcgggagatgagcggggccagccagtcgtagagcagcaccaacaggcctatgaccgcgccgaccgcgagcagtatgaacgcgacggcgatcaccgtggttgtgaattgtggcatggcatcattctcccatattcgtgcgcggtgcgcagcagatgcgcattttcccgtcgcagatggcgaacacacgcatgagacgtcgcccatcagggcacacgccagagtgtcgcatcggctacaatgattgcgtacatagcgcacgggcagcaacagggagggtgaacacatgcgcgtgattttcaatgaaggcctcaaagcggtggccgacgacctcgaccatatggcccgcgatgtgcgcgacgccatccgtctggcgggggaggccctgcttcatcaggatctcgatgcggcccagaccgtgatcgacaacgatgcgagcatcgacgacctttccacccgcatcatggaccaatgcgtggagctgctggcacgccagaatccggtggccaccgacctgcgcgtcatcgtctccacgatgcgcctggccaccaccttcgaacgcatgggcgatctggcgcgccatatcgcggaatccgcgcgccgcacctacccgaactcgccggttccgcagaatctggtgcccacgttcgcgaaaatgcagcagttcctcgacatcacgggcggtcgccttgtcgacatgctcgccgaccgcgacaccgcgatagcggagcagatcattcgcgacgacgaccagctcgacgatctgcatctcaagatcatgcagtacgccgacagcgccgaatgggagggcacgaacgagcagctcatcaacgtggtgctcatcgcacgcttcatggagcgtctcggcgaccatgcagtctccgccgcacgccgcgtcgtgttcatcgtctccggcttcgaccccacgaagacgccgtcgcgagacgaaggcaccgacatcgactgagcgcggaatgcgcatatcggcacagaaaaagcccgggtcacggaagggatgtgtgacccgggcttatgtgttgagcataccgaacatttccgcgttatgcacgtcgcatctcataagcgacgcagcaatatgggcggtgttcccatgccgcatggattacagatgttcaatcacatagtcaatgcagtgcgtgagcgcctcgacgtccgacggatcgaccgaggggaagactccgatgcgcagctgattgcgtcccagcgcgcgatatccgttcacatcgacaatgccgttgtcacgcaacgcctcgagcactgcggcggccggcaccgcgtcaatgaggtcgacggtgaccacggcatgcgagcgggcctcctcatccacaacgtacgggctcgcatagcggctcgcctcggcccaggaatacacggtgttcgcagagcgctcgcatcgcttgacggcccagtcgagaccgccgttgccgttgagatagcgaatctggctctccatgagcacgagcgtggagatcgccggcgtgttgagcgtctggttcttgcgggaattcgaaatcgcggaggtgagcgagaggaacggcggaatccagcggatcgaaccgggaacggcagcgttctccttgaccgcctcggcacgttcgatggcctcgggggagagaatcgccacccacaggccgccctcggatccgaatgccttctgcggggagaaataataggcgtcggtctgcgacaggtccaccggcagcgctccggcgccgctcgtcgcatcgatgatcgtcagcgcgccttggttcacactgccggcgatgcgcttgaccggtgcggcgacgccggtggaggtctcgttctgcgcccagcagtatgcgtcgacgccatcggtgagttcaggcaggcgccaagtgccgaagtcaccctcatatatggccggttcctcgaggaacggagccgaggagagtgaggcggccatcttcttcgtgaacgagccgtacacgccacatgcggccttgcggctgacgagcgagcagcatacgacatcccagaatgcgctcgcgccaccgttgccgagcaccacctcgtagcctgcggggagcgagaagaactcggcgagcccttcacggatcgattcgacgagctgtttcaccggacgctggcggtgggaggtgcccagcagcgtgtctgcggcattggtgaggtcgagaatctgttcacgacggatcttggtggggcccgagccgaagcggccgtctgcgggaagcatgttttgcggaatggtaatagtgctcatgtctttagattataggaaggcatgcgtcgcgcaggtgaatggacgaacggcgttgcattgcttggacgctggacacccaccgggtgagtgtgtaggcacccggctcacgacgaagaatgcgtggattgtgaaggtgcgacaagaaatttacgagattttgtggaaccttgaaattacaggcgtaagcgaggggcgtaccgctgtgtgcccggcgtgttcgatgccgaaagcgcgaatgtgagctgtattttgacggttaggtgaggtatcctgtcgaaagttgcataacgagcacgacagagcgtgcaggctgaaatgaccgaaggagttttttgtatgaggcatgcagccccgaaagcccacaaggggttaggtgcaaaaagcctaacgaactctctgttcgcatcgcgtacgggctcgcattccgcacagggcgtgcgggcgaagcaggcggcggcaggtgacgcgcaggcgctggcaatcgacgaggatctggcagccaagctcaacgaagtcgcacctttgacccgtaaggcgattcgtcagaccgccaaggcggcccagcgcaagcacaacattctcacctccgtctcattggcgacattggtgggaaccgcggcgacgtcgatggccttcatgaagggcgagggctccacagtgctggcggccgaggacccgaccgagaccacgcaagtgcatcgcatcgccgacggttccgcttcgcgctccgatacgcgtgaggctctggacagcgccaccgcaagcagcgagacggctaccgcgacctccgaggtcagctcgtcgtccgccaaggtgaacgtcaccatcgacaacggcaagaccgtctccaccaccaatgcaggcaagtgggggctcggcggcgacaactcgatcgccgattcgaacgcgctttcccgcgcactcgccaacaacccgaaggtcgccgacctcatggacgagcatcagggtcagctgccgcagggcttcgatgccaatcatgaaaccggtgatcgcggcaatgcatacccctacggccagtgcacgtggtgggcgtacgagcgtcgtgcgcaactcggtctcaacaccggctcgcacttcggcaatgcgggctcctgggccgtatccgcaggttccatgggctattgggtcgacaacacgccacgcaataccggcgacgcgctcgtgttctcaccgggtcaggaaggtgcctcgggggtctacggccacgtcgctgtggtggagaaggtgaatcccgacggatccattgagatctccgaatccaatgtgcagggcgtcggcgtgatctcgcatcgcaccttcacctcggcacaggccaggaatttccagtacatccacttctgagtgcgacgtgttcccggttcgcttgccttcttgcaaacgcagtgttatgggtaaccgtgctgtttcgttatttcttcgcggctgagcgttgatatgacgaaacacagggccgcgtttcgtcgtatcgatgccagatagcggcttcatgacgaaactagggcatcagtttcgtccggagcgcgtgaacgagcgactcgatgacgaaacctgtggagcgcattcgccttcacgatgggcacgagcgcggattggctcagtggcaatctgttgcgaggataggtatattccagattcagggtatgctagacaagatatgtccgctccgggcgatatgtgaagaaaacttcataatatagcacactgccagtcgattgtggtctcggcgtgtctcccagtattccaaccattttcttgtaggtttccacaatcgtctcacgttggctgtgctactgtggacgacgatgaatactatgaagcgttctatttcgattgccaccgctgtagttgcagcctcgcttgcgttcaccagcatcgcgccggccgcaaccgccgccgactcccagtcgggctcgaactacgtcgtatcgacccgttcgttcccgaaggtgaacgtggccaaggcgaacttcttcgccgaggcgacctccacggaagtcgacaaggactccaactggggcggtctgggttcaatggatgttccacagaccaaatccacggcagagaaggaagcggaagcccgcgcccaagccgagaaggaaggcgctgagcagcgtgcacaggaagaggccgccgcaaaggcggcacgtgagcaggccgcggccgcaagccgcggccaggcgcgtgaatccctcaccgacaccaatgccaacaccgcccagcaggaagccgctccggccgcgcagccagcagctgccccatccgtgcccaccagcaagaacggtgcagccatcgccgcctatgcccagaagttcatcggcgccccctatgtatcgggtggcaccactccgagcggctgggattgctctggattcgtcatgtatgtcttctcccggttcggcattaatctgccgcgcacctcgggcgcccaggccggtgtcggaaccgccgttccgagcctcgccgaggcccagccgggcgacatcatcgcgaatgccaaccatgctgccatctatattggcaatggcatgatcgtcaacgcgttgaacccggcgcagggtacgcaggtcaccaatctctcggcattcggtggtgctgcctacagcatccgtcgagttctgtgacctctcttgatatacggtgaagggccgcgcatccgttctcgggtgcgcggcccttcgcattccgccgtccatgccgcagcacctgctgagtaaatgaataaagagggcagcgagctgcgtaaaaagagtcggtgagatggccggcgctgtccccttttacgcaagaggtcgcgcacagatcgcgcacagatcgcgcacagagcctgcacggatcacgcatggagcgatggtccctgacgtaaaaggagtcaatgccagggggttatttgtctccttttacggctcttacatgcttaaagggaagagccccttctacacaggagtatgcggggctggcggatggcgacccggtattgggcgatctgcgggcgcatggcatatcggcaggcgtatcgatttgtgcggatttcaccgccgaaacgcgcgcgcatgcgtcggcacggtattctagataccagtacttgtttcattgctggtcaaggaggtccctcatatgaacgacaacacaatcctcgtcggagtcgacggttcgcacgcgagctacaaggcgacatggtgggccgcgaactatgccaagcacatgggactgtccttgcagatcgtctgcgcatactcgttgccgagctatgccgccgtctcgttcgacgccacatacacgtcgatgggcgacgacaacgccgcgcacaacgatgcccaggagattctgtcgaaggccaaggcaatcgccgatgagcagggcgtgaacgcgcagacgctcatcgtgacgggcgatccgtcgtcggtgttcgtcgaactgtcgcgcaactacaatctgatcgtcattggcaaccgcggcaagggaggactggcggagcgtctgctcggcacgacgagctcgagtctgccggcatacgcatactgcccgatcgtcgtcgtgccgtacaccgacgacaaagacaatctgctgcatctcaacaatgtgatcaccaaggtagccgttgggtccgatgacacgaagtggggcctgcgcgcactgcagatcgccgcggatttcgccgcgaactggggcgccgagctggacgtgatcaccgtggtgccgggcaacaccaatctcgacgacccggcacagaagcagaagttcgaagatgtgctcgacgcgcgtctggaatccatctgcacgacacaccccgacctcaagatccgcaaatcgattgtggccggccgcgcagtggagacgctcaccaaggccagtcatacgcacgacatcgtggtggtcggttcctgcggccgtggcggcctcaccggtctgctgttcaactccaccagccaggggttgctccagcattcggcgtcgccggtctacgtggtgccgcgcaagttcgtggaggctgaggaacagcgtgtgaagacgggcaccgcatcgggaaccgagaccgccgaagtgacgtcgctcgaggaattcgtgcgcgaggtaccggttgagcgcgccagcgaggaaaccgaacgccagatcgagatcgacatcgacccgaaggcgcacgagtaccggcaggacgataacgaacagtagtcgggtggtctcccgataacgaaaagccgccgcgggcaatgcaatcgatatattgcccacggcggctctccctttgcgccgcgttcggtcagctgcgcacctcgatgtccatgcgcaccggtgtaacctgttcgtaggtgtgcttgacggtgcatcccttgtcgacgtgagcgcgcacacgcttcttgagcttctcgacgtcctccggggagaggtccgcgtcggtggcgtcgatcatgagggtctcgttgaagttgatgtacgagtcgttgtcggcgtcataggtgccgtcgacgacgatcttggcgcccttgccctcgccgagcgtgctttcgatggcgaagttgctggacagcgccgcgcagcccgccaatgcgatcttcatgagatcgccgggcgtgaactggccgcggcccttgccgaacttgatgtgggcgccgtcatcggagaatgcgtcccacgagccgtccttgttgcgctcgacccaaattcgcttgctcatacgtgccttctttccacgcggatgtgtcgtctcgtttactcaaccacattgtaggcgggtatatgcccgccgtgtcgggctgtattcgctcccggcatcgtctcgtcagactttgcgattacgattgcatgccatgccattgattcaggagcaactgcaagctattcgcacccagattccgccgcgccccgacaccgacatcccgatgccgtatgaggacctgctgcgcaagattctcatggaaggcaatctcaagaacgaccgcaccggcacaggcacgatctcgctgttcggccagcagatgcgtttcgatctggcgaaggggttcccgctgctcaccacgaagcgcgtgttcttcaagggcatcgcctatgaactgctgtggttcttgaagggctcgagcaatgtgcactggctgcaggagcacaatgtgcacatctgggacgagtgggccgacgagaacggtgatcttggtccggtgtacggtgtgcagtggcgcagttggcctgctcccaccgcagacgatcccgaccgcacaatcgaccagatctccaatgtgcttgagctcatcaaacacaacccggattcgcggcgcatggtggtcaccgcgtggaacccggccgaggtggagaacatggcgttgccgccgtgccacgcgctgttccagttctatgtggccgatggcagactcagctgccagctgtaccagcgttcgtgtgacatgttcctcggcgtgccgttcaacatcgccagctattcgctgctcacgatgatgatggcacagcaggccggcttggaacccggtgaattcgtgtggaccggcggcgactgccacatctacgacaatcacgtggagcaggtgcttgagcagctctcgcgcgaaccctacccatacccgaggatggagattcgcaaggccgattctctgttcgactaccagtattccaatttccatatcgcggactatcgataccaccccaccatcaaggctccgatcgcggtgtgagggtcacggtcgattcgatcggccaacatatggaattgcggtgaaaacccgcgaaaacgaagctgcaggtcgtgactcgcctatagactcgatttacgtttgagacttgttccaaggagtgagaaatggagtctggaagtagccgcagtggctatcacgaacccgtgcccggatccgccgggccagaagtcttcgaggatgactggggagatgatttccccaagacgttctcggtgaatctcatatgggcacaggcaaacgacaaggaaggccgttccggtgccattgggtatgagggtgagatgccctggcatctgcctgaagacctgaagcgattcaaggagctcaccgtctcccatccggtgatcatggggcgcaagacctgggaggcgctcaacgagaagttccggccgcttccgaaccgtgacaacatcgtgttgtcgcgtgaccgtgatttccgtgcgccgggtgccaccgtggtggacaatctggaggaggcgctcgatatggcccgtcaggaggccattcccgacgacggactcgaccgcagcgagatctgggtcatcggcggctcccagctgttcaaccagatgttgccaatggcatccaagatctacatgacgcaggtcgacgccaaggtgaatgcggacgcctacgctccagacctcaccgaggcgctcaacaacggttcctggaaactcatggagaattcgggatggctcacgccgaagaagcccgaaggcatcgatcgttaccgttacctgacgttcgaacgcaataccggcgacgaacaggccgaagaggaataacaccaccagaacacatgtgagaggagagagacgaatgggcacgaaaccgcagccgtacacggtgatgaccgtgtgcaccggcaacatctgcagatctccgatggctgagattattctgcgtcacgaattcgaggagcgtgggcttggcgatcgggcgcgcgtggaatccagcggtgtgagcagcgaggagcacggcaacccgattgatcgccgtgccgtgaaagtgctgcgtgagcatgggtacgacattccgccggagcatttcgcgcatcgcatcaccccgaacgagatcgccgagacgaacctgttcctgcccatgactgcctcgcatatgggcgcgctcatgcatatgctgccgttgagcaagcgttcgcatgtgtttatgtatcgcagtttcgacccgaacctgccagacccgcagccgggacgtgaaagcgacatcgatctcgtcgacccatggtatgggggccagcgtgacttcgagatcgccatcgaccagatcgaggaagtcgccccatacatagtcgactatgtggagaagcagctcgaggcgcaggacgcgacgaggtaggggcataagcgttcattgcgcagcatggtctgtacgatctatggaaagggctccgtttctgatggaacggagccctttcgcgtgcaggatggaatgcgtcagtcggtctgcttccaggtctccacgtcgatgtggtgatccgggttcgcctgccatgcgttccatgcggattcgacgatgtcttcgacgtcgtacttggcatgccagcccatctcggtgttgatgcgctcgggggagccgatcagatgcggcggatcgccggcacgacggcccatgacggtctccttgaacggcaggccggtgaccttcttcacctcgtccacgatctgacgcaccgaggtgccctcgccagtgcccacattgaacacatcgtacttgcgctcgtcacggtcaagatacttcaatgcggcgatgtgcgcgtcggcgagatcggagacgtgaatgtagtcgcgcacgcaggtgccgtccggagtcgggtagtcgtcgccgaagatcgccggtgccttgccctgcttgagacggtcgaagagcattgggatgaggttcaggatggccgggtcttcgagctggacggggccgcagccggcgacattgaagtagcgcagtccgcagaaccgaatgccgtacggctgctcacaggcacgcgccatccattcgccgaacagcttggtctggccgtatgggttgatcggaaccatcggttcgacgtcttcgggcaccacatcgaccggcggcacgccgtaggttgcggcggatgaggagaagacgagcttcttcacgccggcctccttcatgccttcgagcacattgagcatgccgttgatgttctgctggtagtaccacagcggcttctccacggattcgccgacctgcttgcgggctgcgaagtggatgacggagtccacattctcggcctccatgatctcggcgagacgttcgccggctcccggtgtcgcgatgtccatgccgtagaggcgtgcgttgccgatgcgattgggcttgccgtagctcaggtcgtcgactacgacgacgtcttcgccggcttcgtgcagtgcatggacgacgtgcgcgccgatgtagccgcagccgcctgtgacaagaacagtcatgttaagcctttccttacagctggtatgaacataggaatggtagaaatgtatccgcaatgttcatatatgtgcgtttatagtgtaacactcgaacactatcgaacacaaatccgtcgtcggtgtgtcgcctggcgagcatgccggtttctgttcgactgtcgcggaaaggcagcgcccgccgccttccagtctagaggccctcctgacgaatgtcgcccggcgtaacgcattatggcgatattcgcgcgcgatggagtgcggtggagcggtgggcggttttgcctgggcgtgcgctcgctggccatttctcggctgtgtcggggtagactgagccgtatgactgagcaaaacaggaatctggaggaatccggcaacggcggtgcggcgaacaatccgcttcacggtcgcaaggttctttcgttcgtgcggcgttccgcgcggctcgatgcgcggttgcaacgggcgctcgacaactatgccgatgagtacatcctctccgatatcgcgctgtcggaggggagtctcgacccgtgcgaagggttcgtgttctcccgggactatgtgcaagggcagtgggggaacgacaatccgctgaccgtggagatcggcagtggtcagggcgagaatgtggtggccgcggccgcggagcatcccgagcgcaatttcctggcgctcgaggtgtatgaccctggtgtcgcgcacaccgtgctgctggcgggcaagcgtggattgcggaatctgcgggtggcgcagatcaacgcgcctgagttgttcgcggtgatggagcccggtgtgcttgacgaggtgtggacgttctttcctgacccatggccgaagatgcggcatcacaagcgcaggatcgtgcagcccgagcttgcgcgtgacgtgcatgcgtcgcttggcgtcgacggggtgtggcgcatcgccaccgacatcgaggactatgcgttgcatgtgcatgaggtgatggatgcacggcgggatttcgagaatctcggcacgctgacggtgagcctgcctgtcgagcatgtgggcaagggcaatgccgagtcggccgctgcgcttccccatgccgatttcatggagtcggagcgtttcgatggccgtgtgcttacgaatttcgaaaagaagggactggccgcggggcgcgtgatccacgatttcgcataccgtgccgtgtgaggtgtctgattgctcgtgcgtcccgccgactttcggggctgcggggcgccatgcaaggccgacacgccgaatttgcgctatgaatggattcgtgtactattaatcgagttgtcgaaagcccccttcgtctaacggttaggacaccagactttcaatctgacaacgagagttcgactctctcagggggtacaaagtaaaagccttggaatttcaacgattccaaggctttttcattatccggtaccaacccagtaacaacacgccgaagaaaaacaccagatcaccgccacagcccgaacacacttttgtcacttaacttcgaattcgacacttacactgccaaagtgttgaatgtctggtcatctgtttgggttgcggtattcctgtataccttgtacaccttggttctgcgtaaaaagggacatctgaagcagctatttcgtccctttttacgtaagagaagagcaggggcgattattccgtgtaaaaggggacgtataaaagcggggttcggtctctttttacgcaagggggattattctgtgtaacaggggatgtctgggtgcctggttgtgtctctatttacgccagagtagttgtcgagatgtgttacgcgagatgctggatcgcctgcacgagtccggcgacgccgctgacccagaacggcgtgagcaggacgaccagtatgacaatctgccatttgcgcgtcatcgaaacataggcgatgaactcgcgcagcaacgcgttcagcgagaaataccaaggagtcttcgaaccatagccgacggcgttcatatgcagttgcttcgacagcaacagtgcgcggaacacatggtagccggtggagacaatggccgtcttcccgtttggatcggcgaacagattccgtgagaacagcagattctcgcgggtgttgcgtgagcgctcctcgcagacggtgtttgccggatctgcgccgtgagcgagcgcccatgccttcattgccacgccttcgggaacgtcttcgcctgcgccctggccaccggagaggatgagccgcgcgtgcggatcctgccgttggatttcgattcccttggcgatgcgtttttgcagcagagggggcaccgtctcgccgaagagcccggagccgagcacgagaatctgtgcgatgttcctcgctttgccgaaatggatgagattgagcgcggaggagaggcagtagatggcgagctgggcggagaagtagaacgtgcatgcggaaagcacgccgaacacccagttgacggcgtcgttgtgcacgctcgcgacgatggccggaaataccaacaggtcggagcaaataagcacgcccagcgccagcgacaggcaattggcgggggagaggccctcgcgtcgcaggagtcgaatgccttcggcgatgaggaagatgccaagggcgaacggaaacagcagcaatgccacggcgacgagggagatggcgatgagcgccaaggtgccgagcagggaaccggtgacatactgagatgccgtcatgagcaatacgatcgaggtggccccgatgccaagcagcatgacgaaggcggagaacccggaccacaacgaacggcggttgaatgccatggtgagcgcgaagaatgtgacgccaacgagcaatgggcaccatgtgagcagggtcatcattgcggaatcggcttgcatggggtctccttatgagtggatgagcgactatcatatgatagccaaattcgggctgtgctgagtccagtacgcgtcgcggcggggaatgccggtgcggccgcccggcggtgcattacaatgattgaatcggacgaacgggaggcgatatggggcagacgctcgataacaaggcattggtaataggcgtcgcgtcgagcgcattgttcgacctgggtgagagcgaccagatcttccgcgaggagggtgttgaagcctacgaacgatatcagaacgagcatttggacgaaccgttccgtcctggtgtcgcgttccccttcatttcgaaattgcttgagttcaattcggtcttcgacggcgatgaccagggtgtggaggtggtggtgctgtcgcgcaacagtccgcgcaccgggttgcgtgtgatgaacagcatcgagcattatgggctcgacatcactcgttcggtgttccgcagcggcatctcgcccttcgagtatatgaaggcgttcgacatggcgctgttcctctcggctgatgatgcggatgtgcgggaggccgtggccgagggattcccagccggctgcgtgctgccgctcagtgattccggaaaccgtggcgatgggaccgcggcggaggcgacgcatgtgcacgagtcgggcgaggagctgcgtgtagccttcgacttcgatggcgtgctcgcgggcgactcggcggagcgcgtgttccgtgaggcccaggtgagcgacccagccaatgcgcttgagaaatacaacgagcatgaggctgacctggcgaacaggccgatcgaggaggggccgctcaaacggttgcttgagggcatcaacatactgcagaatgcggcacgtgaatacagggaggccaatccggcggcccagaccccgaacctgcgcgtcgcgctcgtgacagcgcggagcggaaaggcgcagaaacgagccgtgaacacgttggaggactgggggttgacggtcgacgacgcgttcttcctcggaggcctgaacaaggcgcccttcctcaaccgcatgcagcccgacatcttcttcgacgaccagatgggcaatctcgaccggtacacgctctccataccctcggtgcacatcccgttcggcgcgcacaacggggaataggtcgacgacgggtggctaggaagaactgagggcgccatgtggtcacgcggtggatgattgcggggcatcatagaattcacaatgtgcatgttatgctggaacaatgcaaccaaataagacgctgagcgtgaatggcgagccctttgaggtgctacggctgcttgggaaagggaagggaggctactccttcctcgttcgttctcaatcgcattcgaaaaccgaatacgtgctcaaacaaatgcaccatgaacccatgccattccttcagcccaacgacaaagtgcaggcggagatccgcgattaccgccgactgtgcgagctcggcatacggttgccggcgatgcttgacatcgacatcgccaaggagcgcattctcaaggaatacatcgacggccccacggtctacaatctggtgctcaccgaccagatggacgactcctacgtggaccaggtgcgcgagatggccaagcgcctgcaatcccaccgtctgaacatcgattacttcccgacgaatttcgtggtggaaaacgggctggtgtactatatagacttcgaatgcaccgcctacacacgcgaacgcagcttcgacggctggggcgtcacctactggtcgaagacccctgaattcctgcggttcgtggccgcgcatgcaccgcatgcacccgctgcggcgcaatgacatgatttcaaggaatcggtggcccatgagactgacctcgctgagcattgcgaaccacagccgcgtcaccgatttccgaatcgacgtccgccggcatctcgtgctggtgggtacgaatgaatccggcaaatcctccattctgcggtgcctcgatcttgtgttgggcaagtcgaccgccgacctgtatgccacggtcactgcggcggatattcgcgagccgcaactgccgttcaccattgccgtcgagctggagaacgacggcatgcacacttgcatgcgcttcgaggccgcgcttgatgccgatggcgagaccgtgcacatctcgcgcacaatgggagacgatggacacgtcgtgaccgcggccgatctggcgcgaatcggctgggtgtacctttccgattccttcccgtcgaaccgtgagacccagcatgagattgtcgacgaactgctcgaaaccgtgcaacttgagcaggaggaagccgttttcgaggcggtcgcagaccagtacgcgcgcctgttgcactcctcgccggcccttctcgcattgcgcaaacgcatcgccgacgcgctcacgtcggcgctcccgatgcgttgcaatccgaacaatctcatgttcgtgccgggttccaaactcaaccgcaatccgttcagcgacgtgcacctgcaattgcgcatgcacggcaagcagcgtggcctatgggagcaatcgggaggcttgcggtcgatctacaccgttgccttgtatgatctgctcgacgagcacgtgcatatcgtcggtgtcgatgagcccgaaacgcatctgcatccgacgagccagcgaaatctggcgcgattgctcaaggagggggcgagccagaagatcctcgccacgcactcgcccgacatcataggcgaattcgagcccgaccagatcgtcgtcgtgcgcgcgaacggcggcgtggtccaaccccgtcgcgatttcctgagcgaagacgacaagctgcttctgcatatgtgggtgcgcgaccggctcgaaccgctcaccgccgagcatgtgatcgtggtggaaggcgtgacggatcgcgcgctcgtcgaacattgcgccaatgtgaccgggcgtaatctcgatgcccacggcgtcgtgctgctcgaagcaggcggttgccgtgagatgcccgcatggcagcgtgtgttcggcgaacacggcttccgcgtgccgctcacgcaactcgttgacgaggatgcccagggcgatctcgcacaccagtaccatgtacgggccggcgaacttgaatccaagcttgtgtttgtctcacacgtcgatctcgaagccgagtacattcgcgcactgggagtcgatctcgcatacgaagcgctttcacagagcaatctgttccgcccggcggagacgaagtcgttgcgcacggcacgccagcaggggacgctgaatgagagcatgctcgcagatttctgccgcatgcgcgcgaacaagacgcgtgccgtgcttgccgtgctgccccggatcagcgcgaaacgggctcgtaggatcgacagtgtgcaaagactgctcacttcggtgatcggtctggcatgagctcctccccagatgattgcgaatgctggcgttcgctatggcattccacagccgtcgcttgacagtgacacctcgaattgccagtatgttcgatacgactcgaatatgctggcaatctcaatatggagtgggtatggtgtctcgaacgatcggaacacggtgcagatcactgttggctgccgtgggtgcgttgacgttgtgcgtggcgctgggggcgtgcggtgcgaggcatgacgagcgcgctgcggaaggcagatcgcaggtcgctccctcgcccacaccctcgcagactgctcaggaacgcacgcgcggcacggactcgttgctttccgccgatctgatcgaacagattcgccaactggacggcaactcggatccgcagaccacgcgttcggtgttcgccggcattctcttcaacggtccgggccatgagagcccgggcggtccggggcgtggggcgactccggatgcgacgcgaacaagccggtgcgcgtgatcaccgtgcgtggtacgaacgagcaactcaacggcggcatgctggggccgctcgcgcagcagatcgcaagtgcgtccccgggtcacattcaagtgacaccactggagtatgcggcaagcgtggagcccggaacgcaggcggacggcgtgaatctgctcatgagcaccctcaatgggcaggccgagcagtgcccggcgcagcacaccgtgctgctcgggtactcgcagggagcgatggtggtgggggacgcgctgagcgcgcccgatgtgcggccgaacgaagacaacgggtatacgcttagtgaccgggcctcggagaatgtcatcgtagcggaattgttcggcgacccacgcttcaacagcgagacatcgtatgacgtcggcgatttcaccaaaggcacgaacggcgtgatgggagcccgcggcccgcacgagctcgaccgatatgcctcgcgtacacagagctattgcaattacgacgacccgatctgccagacgtatgggtcgcgtaaggggcaccgcgaatacgcgacgaacggcttgcgcgaccaggcgcatacgcgccgtgctgcggtgaatcgtcgcatgcgcatgcatatgcgcaatatatggcgggcgcatgttcgtggaatatcatggaatacatatcgatgcacggaaagggagccatggcaagccatgagatcaagtgcccgcattgcggggaatcgttcaccatcgacgaggcgggctacgccgacatcgtgcagcaggtgcgggggcaggaattcgaccgcgaactcgaatcacgcctgaagctggccgaagacgacaaggcgaaggcggttgagctcgcacggcagaaggcgaacagcgagctgcagcaggcgaaggcgagcaaggacgccgagattagtgaactcaaagcacagctggcggcattcgaagaccgtcagaaactcgcggtgtccgaagcggtgggcgatgtggagaaggaacgcgacgagctccgccacgaggtggaacggctgaaatcggatgccgaatcggagcgggagctggccaaggcgaatttggaggccgagaaggcgaaagcggcggccgagaaggacgtgcggatccaacagctgcagtcgcaactcgacaatgtgcagacctcgaagcagctcgagatcgccgagcaggtgggcaaggtcgaacgtgagtgcgaccggctgcgtggtgaactcagcacggcgaagatgcagcaggaactcgagctcaagtcggtgcgggagcaatacgaggtgcagctgcgtgaccgggaagacgagatcgagcgtctgcgcgatttcaaaacgcggctctccacgaagatggtgggcgaatcgctggaacggcactgtcaggacgaattcaacaaagtgcgcatgggttcgttcccgaacgcatacttcgaaaaggacaacgatgcgcgaaccggcagcaagggcgatttcatcttccgtgattacgacggaccggaggatgacgagggtcgcaccgagttcatctcgatcatgttcgagatgaagaacgagaacgagacgaccgccacgaagcacaggaacgaggacttcttcaaggagctcgacaaagacaggcgcgagaagggctgcgaatatgcggtgctcgtgtcgatgctcgaagaggacagcgacctgtacaaccaggggatcgtcgacgtctcgtaccgctacccgaagatgtacgtgattcgcccccaatacttcatccagatgatcacgctgttgcgcaacgcggcacgcggcaccttggaatacaggcgcgaactggccgaaatgcgcgcccagaacatcgacatcacgaacttcgaagacaagctcaacgaattcaaaagcggattcgaacgcaattacgagctcgcctcgaagaagttccagaccgtgatcgacgagatcgacaagtcgatcgaccacctgcagaagacgaagaaggcattgctcggttccgaagacaacctgaggatcgcgaacaagaaggtgcaggaggtgacggtgcgccgcttgacatacaagaatccgacgatgcaggagaaattcaagcaggcgcgggctgtgcgggacgaggagaaggcgatcgggaaggttcccgaggtcgggatcgagctcgccgaagacaccggcgtggagagataaggccagcccgcaaggatctgcacaagggtgagccgcagatgaatgcggtgatctgttctgattgcggcattcggtggattcggtagaatacaaggacgggaaggagcggcggcatggcggatgtgcggagcgagctggcgcagttgaggccggtgtatgagaccggcgtgctgcgcatgctgctgcataagtattccgacatctacatcgccatgctgcgcgcctgcttcgacccgctcactgcagaagtcccgcaggagcgactgctggcgcgtatgcgcgaggcgatcggcgagctcgccgccgatggcacctacactccgcgtgagggcgaggacgacatgatggccgcccggcgcatactcaaggagctcaaagccgaggatgccggcgactacgcgtgggtggccgattcgatcgaccgccgccagcacaggctcatgtgccgcctgacccagcgtgcccatagagccatcgaggcattggcaacgcttcagcaacgcacggtgtcgctgtccggtgcgcaggtgaattcgatcatcatggagatcgagagcgcgcgcaaacagctcaccgtgaatgtggaggagcgcattgagctgctcgaacgcgagatagaggagcggcgacaccagatcgacaatctcaaggcgcatggcattgggcagcggcccactcgcgagcaggtgtctgacatcatcaacgtcgtgtacaacacgctgcgcggtgtgcctgtcgatttgcgtgagttggtgatcaccgagcgtgacaatggcgatgcgttgcgacggcgcatcgacgacggttcgatgagcagcaatgacatgctcacgttctaccacgaggaatacgagcgcacgtaccggctcagcgacgagggacgccgcttcaacgatgcattccaggtaatgtatgccccgcagagccgcgaggagctcaatgaggcgctgcaagacatctcgaacagcgaatggctgcatggcgaggccgacgacctcatgagcgtggtcaatcgggagttcgaagacatctacgacggcatagacgatgtgcgtcaccagattcgtgtgaccgacgaaagcgtgaagcttctggtgaggcagcagaccgacatgcagttccgcacgatgtctcgtcagctcgcgaagctgttcacccagttgggtgagtcggtgcatgcgaaaggccgctacgacattggcacggcgaccacctcgttgctcacattgccgacccgtgcgcgtgaaacacccgtgaaaaccgcggctcccgaactgcagatgcaggcggacgacggcatcgcacaggtcgatctcaatggcatcgttgcggccggcggcccacgcatccaccatatgatcgaattggtggccgcgcacccggtgctcatcgacgatgccggcgatgcgctcgccgattccgttgtcgacatcgcagccagtttcaacgaacttcccgccgacgaacgccgtgagagcgaaatcgtgggcttcctgagttatctgggttccgcgtcgcctgccggtgccgctggcaatagcgatggcggccagattcccgtgccccgcgagagtctatggcattgcgtgaccaccgacggtcggactcgcgtatggcgcacctgcgcgctgttcgtgcccgggcaggtgctgaaggattttctcgacgataccatggtggaggactgatatggcgatggacgacagcaccgggcagggaattgccggcgatgccaatctgggcatggtctcgaaggtgctcagtgccgagtatgaggaaggtgtggccgacgaggccggcatggccgatctggccaatgtgcacgcactgttcgatggtgacatcggcgacatgcccgcacccgcccgtgaggctgcgattgcgctgaaacgcaacaggtcgatcagcggcgacatgtaccaccaggcactcgactatatggaacacgtgcggcgttcgctcaacaacgacatgctcgtgccggtcatcgacacctactatgaggtgatgtatgcggagccgatcaccgccgatgaatacggcatacgatcgctcaagacccgtgccagcctgagtgcccgtgaggcggtgatgctggccgcgctgcggcgcaaggtgctcgactacgagaatgtgggcgccgcggccgccgattggctcatttcgaaggaggagatcgtcaacacgatgtccaccggcgcgggcccgcttgccggccgcaattcggaggaggcggtgcaggcgcaggtggaccgcctgatcggcagtgcgaagaacaacggcttcctggcgcctgtcgaagatgacgaaggcatgtatgtgatcaccaaactcgtgcccgtggtgctcaatccggagcgcatcgccgcatggctcggcgcggacgacgcatcgaccgcacagcccgaaccggatggaacaggtgacgattccgacggctccgggcataccggccaagacgaacaccccgaagatgacgatatggaggcgctgttttgagcgagacttccgacatctatgcctcgattgaactcatgccgccgcattgggcgcttgcctcgcggcaattggtgaattggggttcctacgacggctaccatgtattcgagccttccaccgccggaaacgatacggtgacgttgctcaccggccagagcgaatcgggaaaatccacactcgtcgatgcgcaggtctcgttgctctacccggcgaatgccgcattcaacaaggcctcgaacgccggacgctccgatcgcagcgactactcatacctgttggggctgaggggaatccgcaacaacaacgggcacgacgaaccggtctacctgcgcgggcgcagcgggaacggggagccgtacgcggtatggggtgcgatcgtcgaccactatgtcgacaccgccaacagcggcgcgttatggattgccaagttcatgtatctgcctgcggacggcgcgccggagagcatggtgaagctctacgtggtctccggctatgcaatcgacccgcggctcatggatgcacatcgcgaggagcgcttctcggtaccgcttatcaagcaggtgtacccaggtgtcaccgtgtataactacgcgaagcagttccacgaagacatctggaaacgattcggcctcactgagtccgcgtgccgtctgcttcaccgcatgcaggcctccgacgcgccctcccagctcgatgacatcttccgcaaaggtgtgctcaatgagccgcgcgccgttgagttcggcaagctcgccatcgatgattacgaacagttcgccgagaatttctcgagtatggagcgtacgcgcaagcgagtgcggcagctggaggcgattgcctccgagttcgccgagtatgagtccgccgaacgcggtgtgcgcgagctttccaccatcgcccccgagcagggcgatagcgcacggattcgcacccaatggcttgacgatcgcattcatgccgacatcaccgaagtcctgcccgaatatgagcagcatgccacggactgcagtgccagtgcacaggccgccaaagagcgggcggagcagatgcgggaacaggccgactcgctcaataggcagcttcagggtatgggaggcgacgagataagccgtctggaagaccgcattcgcgatgcacaacggcgccaacgcgaagtgttgggacgcagggagctgttggcctcccgattcagtgcctctggcgaagcattgccggaaagtcgcgggcagtgggatgcattggtggccgaatacacgcaattcgaatcggaataccagcagcgtaaaaccgaattgcacgggttgcagtacccattgatcgacgcccagaagaaagccgaacagcgaaccaaggcactcgagaaggacttggaacgcaaacgccagtcgaagacgcgcatctccagcgatatggacgaggcccgcaatatgattgcgcgcgccaccggcctgagcccgcaggagctgccttatgcggcggagctcatggacgtgggcgaggagaacgaggagtggcgcaccgccatgaacgtggcataccggtcgctcgcaacggtgattctggtcgacagttgccatgagaacggcttcgcagcgaaagtctcgcagattccccaggaggcgctcccacgacgcaactggcggttcgtcgacacgagcgtccatgtggaggctgaggagcgtgaagggtggctgtcgagcaagctcacgttcaacgtggaatctccgttcgccgattggcttcgtgcccgggtgaccgaggcgcggtacgacgcatggtgcgtggaggcgatcgacgacaccaatgagacgacgcgccaggtgcagcgcgacgggcagatcaaggaaggtcggaagggcagtcacggcaccaagaacatgcctgccgtcatcggattcgtcaccgatgcctatctgcgcgatctggaggcagacattgccgaggcgcgcaagacgcgggatgccgcaactcgcgatctcgaacagtacgacgtgcaactcaacgcgcttgagcaacgccatagtctggcccagacgctgcaggaccatgcatggaacgacatagacgcatatggtgtggaggaggaaatcgccagcctccaacaacgcgtcgacgaactcgagcagaaccccgaactggcacagctcaatgccacgctgaaagtccagcagcaggaaatggccaaggcgaacagtgcatgctatgccgcggaagacaaactcaagcgggcgaatgcggcggtgaggtcgacccggcagtggctggaagcgtatgaccggcgcacgcaatccgtggaacgccggcctttgaacgaggcatgcggtcggctgcttgaacggggatatctggcatacttcggcgagagcacacaatcggcgaacgaacgaatgggcagaatactcggtttggacgggcaatcctgcacctcactgggcggccatgtacgcgagaacgaggcctgcgccaaacacgtacgcgaactgctcggcacactcgcccaaaccgtgggcaggcaggtgaaggaactggctacacagcgcgacaaccggaaacggtcatgcgaggcgagcatgcgctcgtacctcgaccagtatgcgtcaggcgacgaacgagtgagcgccgaggtggagaacgagcggtacttcaggaaagacctggaggagctcaaaccaggggtgatcggcgacgaggcgacgaacgtggagtacatgaactcgctcgacaagatgctccaggacctcgtgcagttgcagacgatgctcaaacttgaccagcagaggatcaccgaacagatcggcaaaatcaaccatctgcttgaacggtacccgttcggggcgcgaggcggtaggctgtcgatcgtcgtgcaggtgcacaggcccgatgcgaagttcaccacggcactcaccgggcaaatcggccgcatcaatgcgttcaaggcaaacgacgagcatgacgtggagaggtgccgaaagctgttcgccggccttgcgggactcatcgagatgctgcgcggcagcttcgacgaatatgcgggcaacggacgtggcaacgcgaacctcgacccacgcaaacgctcacggttcttcgggtcggtgacgaacccggatggcgtggtggaatcgatcaactccaccggcggcggctcgggcggctatttgcaggagctcacgtcgttcgcctacggcgcggcgctcatgtatctgctcgccaccgacaacgcaaccgaaccctcgtatgccaccgtcttcctcgacgaggcgctcatcaaagccgacggccagtacacgcgccgtgcattgagcgtgctgccgggactcggcttccaagtgatcgtttcggcaccggaatcgaagaccggcgagatcatgggttcggcttcgaaggtcattgtggcgcgcaaggaccaggccagcggcaggacgacgctgatgcagggagatctgctgggggacgctgatggcgatgagtcctcgatgggggagcggtccgagtgacggatacggcgacgctcaagactccggcggatgtgcgcggcgatgtggcgcgcattgtacagcgcgagttgttcgccgccgagagtccatggccgcgcacgattcacattccgtggcccaaggagacgcagctcgtcgccgatgtggccggcgtgcatgcggcgaataatgcgttgaaggagttcgcggcacgattcggctgccaaaccgacttcatctcgcgcaaaatgggcacggccgtgtcgcttgtcgcgcatatccatgtgcctgacgaggccacggcgctcgccattgcggggcctacgctgcgacgccctcgcgaacgagtgttggccagagcggcgcagctcgagcaacgatgccatgtcgaccatgcgctcgccatggacgtggtacgcaggttgaacaacgaatccgacgtcgatttcgggttgttcgtcgaagccgcgcagtggttcggccggcattgggccgaagtgccggggctcaccgctcgtgagatccccttgcccgggttttcggcgaaatggctggcaggttcacgatcccgcaggcgggcggcgatctgtacagtgctcggtgtggatcggctgccgctgcgggaacgcccgggcgaggtgcggtaccggtacatggaccaacggttcgccgccgaacctgaccgtgtggcgacctcggtgcagtgcgttcccgaacgccccgtctcgctggccgtcattgtggagaacaaagacacctaccaagccatgggccccattgacggagccgtatgtgtgttcggctccggattcgccgtgaaccgggtacccgaactgttgccctggcttgccggtgatggggtgcgcgttgtgtattggggcgacatcgatgctgcgggattcgagattctcagtgggctgcgggcttcgggggtcgcttgtgagagcgtattgatggatcgcatgacctatgccgaatacgagcgtttcggcacgacgagggatgcggcgagccatgagattcgctgcggcgaaccgaagcatgggctgcatctcagtccggaggagtatgcgctgtaccgtgacctgtgcacgggcgaacttgccgtgccgcgcatcgagcaggaacgcattccgattgctgaattcatgcgcttgatcagcgcaggccggagcgatggaagtgacggtgcaagagccgaccaatgccatagccaatcgctgcgcacaccaaagtgatgccgccatacagtgcgaatacgtcgataccacgcgtcgctgaagcgagtatggcgatttcgacggccgctgcggcgagtccgagccagtacccatgcaccgaacctgccgtggcggtcgcggttgccgcgagcgccagcaccgggaacacgaacatgagcatgaatcccgtgatgaatccatattggtcggtgcatcgcagcacgatggcgatcaacatgccgatgccgaggatgatccacccgatggtcataagcaggcgactggtgccacgattcgcatcagtgtgctccgtcatactggaagtcccctgtttgtggagtgtgcggaactcattccatcatatcggatcggaggagcgggcggttcattgaaccttctggcgctcctcgacgtagtcgcgtagaatgcgtgcatggttcacgagcgggtcacgcgcgccatacacgaaagtgaccaccggatggtcggcaaggatctgttcgagctgctccactgcgggattggcgtcgagttcacgccggtagctttcggcgaattccagaatcgtgttgggattgtggttccatgccttgcgtaagtcggtgctcggggcgatctgcttcatccacagatccagatgttccttcgccttcgacatgccacgtggccataggcgatcgacgagaatgcggtatccgtcatccggctcggccggtgcatatgcgcgtttgagttgaatcattgccatgacacacagtgtatgccgcttcgaatgcatgggcgattgttatacgacggactgaatgcgtgtgtcgtatgcgatggcccgccaggatgccgttcttgttctattgcccagcagattcattggcgccgtgtctgtgtgctacctcgtgttttccgctattgggataagttgtttcggaagtggatagaggggggtacgcacaccctaggagaagaaaggtgcgcgcactggttttgcacgtcgttgtgcaaatttgtcaagacgcggtcatgtcaccgttccgtgttcgcagagtcagcaagctgcgtctcgagctcgcgaacaatctgcgcatggcgcttctcgtcgatgcgcaccgtgagcaggaacacgatcaggctgagcacaatgccggcggacggcacaatgtacgcccaagtggtgaacgtatggatgttcgcactcgtcatatccgcggcggaagccgatcccaccatgccagcagccactgcgacgaagccgacgatgccgttcgagaaggcgcctgcgatcttgtcgagcatcggtcgcacgctcagcgtcaccgcctcgttgcgctgcccggttttgagctgtccgtattcgatcgaatcggtcatcgtgagaatcgcggtcatctgaatcgtttgcgcaggcagatagaacagaatgagcgcgacgagcacgaccgatagattgcgcggggccgcaatgaacaatgcatacccgagaatcatgagccccatgcctccggcgaacaaccatcgacgtgggatcacacggttgagcaacggatacagcggcgtggtgaccaggccggtgatcacgggaatcacgcccgcgatggcgaaacgctgcggcatgccgagcacataggtgaactggtagaacagcacgccggtggtcgccacgttcgcaatggcatacagcaggtagctcaatgcggtccacagcagttggtcgttgtgggcgatggccttgaacgcgtcaagtgggccgcaatgggagtcctgtttgcgtagctcgctcgagctctcacgtgtaccgaatgcgacggtccacgcggtgatgagccccagcagtgcgacgatgatggcaaatgcagtccaccccggttggccttcgccctgctcgccggtgaatttgaaggtgaagtagctgacgatgggaatgacgacgacggtgatgccgttatagccaagcgaaccggtgagcgtgccgagtgaagtgtagacgctgcgttcatgcgaatcgctggagagtgccggaatcatgccccaataggagatgtcgcgcgccgagtagaacacgtcgagcagaatgaacgtgacaatgaacagcgtgatgaaccaggtggtgttcacgttgacgagtccaaacaggccggtgaacaccaccacgagcagcacggagggcacaatgcctccgatgaactgccagacgcggaaacggccccacttggtgcgcgtgttgtcgacgatattgcccaagatcgggtcgaggaagatctccgcgatgcggatggcaacgaccagtccggtgatcagggctatcatgcgcgcggccacggccttgtcggtgcgcgcgaacaacgccgtggtcacgtaggtcatgaagaacgtgctcatggcgttgtagaacgccgcctgaccaagattgccgaaggcgaaggccgcgcgctggcggattaaaccgtgtcgtgcggtcttcggggtggtcgaacggagcatgtcggaggatgcggcagacgacgctgtctgcccggcacccgcttggaatttgttggtggtcatgtgacctaacctccttcattggcgattacagttcatatactatacatgatttactaaatttgtttaccgtgtgttggtgtcgatctgtctaattatcgattgctgcagtatttgaaaatcggctcaggatatatgtttcatggatatatgctctttctgtgtgaatgtctgtctatgaagagattgcgcaatgtgctgaattcttgttgcgtgatattggtaaatagtttactattgcgtagtacaccgaagtacagagccgacggtaccagcgttggtgccgcggtcaaatgcgagtcaggagcaacgatgaacgaggagaccttgcaggaagtcgcagaggagaaggcgaccgagcccccgcgcaatgatgtgccgtccactgatggagctctgcgatccgaagagccgacggcggcgtggctgaccgatccccgtgtgttcgcggtcaaccggctgccggggcataccgaccacaattgcgccgacgatcagtccggcgcgttgaagcagcacctcgacggcgaatgggcggtgaaggtggtgccctcgcacttggatcggctccccacggagggcttggatgagcattggcagcacgcccaccttccgccggaattcgcatcgcgcagcttcgccgatggcgacttcacccgtgtgcaggtgccggggtgtctggagatgcaggggctcatgcgtccgcaatatgtgaacatccaatatccgtgggatggccatgaaaatccgcaggcaccctccgttcccacagacaatctggtcgcactgtaccggcgtgcgttcactgccgatgatcgcgtgggcgaggcgctgtcccgcggggagcgcgtgagtctgaccttccacggtgcggcgacggcgatctacgtgtggctcaacggcgtgttcgtggggtacgcagaggattcctacacccccagcgagttcgatgtgaccgaggcgctgcatgcgggggagaatctgcttgccgtggcgtgcttccaatattcgagtgcgagttggctggaagaccaggattgctggcgtttccacggattgttccgcgacgtggagctggaggtgcgacctcacgcccatgttcgcgacatgcttgcgcatgcggattggaatgtggatgcgcagtgcggtgagctcgccgtcgaactcgatctcgacggggcgtggtgtgcggccaatgtggagctgcggctcagcacatgggaagagcacgcagacggcgcggccctgctgtggagcgcgacggtggaatctgctccgaagatccgctacgccacgacatgcgaacaggtgctgccgtggagcgcggagcagccgaatctgtacgttctcgaggctgtggtgcgcgatgcgaacggtcgtgtgctggaaaccgcgcgcacgcgcatcggattccgccatgtggagattcgcgatggcgtgcttgtgctcaatggcgaacgcattgtgttccatggcgtcaaccggcacgaattcgacgcgcggcgcggacgcagcgtcaccgaggaggacatgctgtgggatgtgcggttcatgaagcggcacaacatcaatgccgtgcgcacctcgcattacccgaatcagacgcggtggatggagctgtgcgacgaatacggactctatgtgatcgacgaggccaatctggagacgcatggcagctggaatctgcccggtgacacggccgatggcgtctcgataccgggggacgacgtgcgttggcagccggcttgcgtggaccgtgtggagagcatggtgcgccgagaccgaaaccatgcgtgcgtggtcgcgtggtcgctcggcaacgaatcgtacgcgggcgatgtgatccgcgcgatggggaatcgctgccgagagctcgaccccacccggccggtgcactacgagggcgtgacctggaaccgtgaatacgacgacatcagcgatttcgaatcgcgtatgtatgcgaagcccgatgagattcgcgaatacctggaaagtgatccggcgaaaccgtacatctcctgcgaattcatgcatgcgatgggcaattcggtgggaggactgggtgaatacgtcgccttggagcgctacccgcaataccaaggcggcttcatctgggacttcatggatcaggcactatggcagcggctcgacgacggcacggaacgcctggcctatggcggcgatttcggcgacaggccgagtgattacgagttcagcggcgatggcattgtgttcgccgaccggaccgtgtcggcgaaggcgcaagaggtgaaggcacaatatgccggcgtgcgtctcgaaccggatgggcgcggtgtgcgcgtgaccaatacgaatgcgttccaaggcacctcgggcaccgtgtttgtggcgcggatgcttctggacggacgtgaggcatggtcgaagagctatgagttcgaggtggcggccggaagcgcccgaagcttcgacatcggcttccctgacgtgcacagtctgcccgacggtggcgtcatgcatgaggtggtgtatgaggtgagtcagcagttggcgcatgacaccgcctgggcggaagcggggtatgagatcgcatggggacaggccgtggtgcgtccccatgcgagtggccgcagcgggtcgaagatgaatgatgcgttcgatgacgacaatctgcagatcgtcactctcgggcgatggaacgccggagtgcgtgttgggcagcgtgagatcctgctgtcgcgcacgcatggcggagtcatctcgttgcgcgacggtgagcgtgaatatgtgattcgtgtgccgaaactgctcacgttccgcccgctcaccgacaacgaccgtggcatgagctccggtttcgaccgcgtgcagtggttcggtgccgggcggtatgcgcgcgtcgtcaccggcgtgggccaggtgtaccgcgacgagctcaccggagatctgtgcggcgagtactggtatgagttggcagacggcgcgcagacgcaggtgccgattcgttatcgtatcgattcgcagttgcgcatgcatatcgaacttgagtatacggggtgtgcgggtgcgccgagcctgccggctttcggattggagtggatgctgccgaaacagtatgagaatctggaattctatggtcgggggcctgccgagacctaccgtgaccgcaagcgcgccaagctcggcatctggaacaccacggcgcaggcggacatggcgccgtatctggtgccgcaggaaaccggcaatcacgaggatgtgcgttgggcctatgtgtttgacgccgattgccatgggctgctcgtggaggccgacgactcgctcgcgctcagcctgctgccgcacagttcgttggagatcgaaaatgccacacaccagaacgagttggcgcaaccacgtcatatgttcctgcgcctgctcgcagggcagatgggcgtgggcggcgacgactcgtggggcgctcctgttcacgatcggtatctgctgccggcagacgaaccgctcaagctggccgtgacaatcagcatgctctgactcatgcattccgaacatgacgaacccgtgtctgtgtgcacgggttcgtcatgcggaggagtctgtgaatatgaccaaccagtgcgcacgcgcacgtatgagtcatgatttgcttggcagactttcgcggcgaacaagctcggtgctcagcagaacatgccggcgcacgtgcctgtcgcgcgcgatggcgtcggtgagtgtggtgagcgccgcatagacgagttcatgcaggtcgatggcgtaggaactcagcggcggtgcggtgtactgcgcgatcggcagattgtcgacgctcacgacggcgatgtccgtgggcacgcgcacgccggcctctgcgaaggcttgcagcacgccgacggccatagggtcggagccgatcacgagcgcgttgggaagatcgtcggggtggtcggtgaggagacgagcggcgagtgcgcgtccgttgctcacggtgaacgggccgtcggcgtagatatactgctcgttcggcaggcccaggcgcttgctccagtcgctgaatgcgagcgagcgaatgtcttcggtgtggttgtgcaggcccatgatcgagccgacgccaccgatgtagccgatgcacgtgtaaccgtcgacgagaagtgtatcgagggcatcgagcatcgtttggctcaggtcggggcgtaccgaatcgaaccagtccggcgccggattcgtgtcaatgaacacgccgtagcggagtgcgtcgcgcaggtgggccagatcggtgcgctggaaagaggtgggtccggtggcgacgaagccgtcgtggtcgtcggcgtgtgcgatgagactgtctatcgagtcgaagaaagtgagcgtcgtgccctgctcggctgcgaccttgcgcaactcggtttgcagcgactggaaataggcgtcctgcaattcgtcgaattgtggcggcacgttgagcacggctatcgaacggctcgtgaacgcccggtagccaagttccgcagccgtgcgcatgattctgcggcgtgtgtccgccttcaccttgagggtggggtcaccgttgagcagacgggagacagtgctttgcgagacgccggcctgctcggcgatgtctttgcgagtgaccatggatccccttcgtctgcgtgagcggtctgtggttgaggatggggcgtgcgtgaacggattgcggtatggcagacccgatccttcggtacattaatctaccacgctccgaaccgccgccctccgtcgatgcgggacgtgttttgatcaagctgcctgtggcggttaccgccgccatgttatcccgtgttccatgctcgtgcaacaggtaccgggccattaatctgaccactttgtttgtttactgcaccgtaaccgtgcgtgggcgagcggcaagcccacttccggcaggatcgagatatcgagagaagggaagtggtcatgcaggaattggaatattgctcgacgattcggtgcgcgcggcgagtggagcggccggcggtgcagtggaggaatctggtatgtgaatgcctgctgcaggcggacgggagaagacatgccgatcaccgacgtcgtattcgactactgcggagtgctgctcgattggcggccggagctcaccatggagggcaaggtcgacacgtccaccatgcggcgtctgctcgatcatgcagatccttacggattctggcactacgatctgatgagcgatctcggctggagcgaggagcaggtgctgcgcgatttcgcgcgacatcacccgcacgatgtcgcgctcaaccacgcaatgcaactctatttcgcgaattacacgcgcgcgttcgccggcatggtcgacggcatgccggaactgctccgcacgctgcatgaacgtggatatagactctggggcctgaccaatttcagcacgccgttcgtcacgcttgcacacagagaattcccggcgctgcgtctgctcctcgacacggtcgtgtcgtcagaggtgcgttgcgcgaaaccggacgcgcgcatctacgagatcgcgatggaacgcttcggcatcgatccggcacatgccatgttcttcgacgacaaatatgagaacgcgaaggcggcgagcgaatcgggcatgcatggcgtgcagttcctcagcgcagaccaggcgatgcaggccatactcgggtaatccgcgaatccatgcgccatcattgtgcgcagggcatatcgagtccgtcgggccagtgcgaatacatatgggaaggggcttgcccatatgggcaggccccgacggaaaccgccgtgttgaaccggcctactttgcgagggaatcgcgtacgcgggtcaccgcgctctgcgcctcgcttggaatctcgcgaatatgctgcgaaatcgtgtccattgccttgcgcacgtccttgttccgggcgatctggcggctcttgtcgctggccagatgctgcatgttctccttgaactcgtcgagattggcggccgccttgtcgagtttgcccttgcgctgcagcatcagaagcaccacgatattgatgcacaggcacatcacgctcgtcacgatgaagcagatgatcaccgcacgccgcagattatgttccgttgcatccgcatcagccacatccggattgtcgtctggatcgttgagatcctcgatgtcgcgttcggtcagctcatcactggtcttgtcttctgccatgtctacctcgtttcccgcgcatgtgcgcgttttctgattccacggtacgtcgtctgcacgggatgcgatgcgcagtcttctctcggcgttatgtacgaaatcgtgctgaatgaggagcatgcggggataggggacggaattggaatatgcgcctatgccgtgcgttcttgcagtatgctttgcatatgactgcaaacgataccctcggctcaccgtactcgtctccggaccccaatgagcatggcgacaatccgtacgtcggagaccccggctactcacaggtccctcagcaggcatacacggcacagtatgcgactccgcagccaaactacacgcagcagtatcctccacagggtgcctacggttatcccatggctccggtggaccagtggaacggcatgtgcattgccggtttcatctgctcgttcttcttcccgctcgttggcctcgtgctttcgatcatcgcgctcgtgcagatcaataaaaccggcgagaagagccgaggcatggccatcgccggcattgtgatcggcggcatctcgacggcgctcgctctcattgcgatcatcatggtcatctgcggattggcgattgggctcggcgcgctcgccgaaacaggatgggacgattacgagtaccactacgatacacacagtgactactcgcagttcgacgaggtgggtgcagattaccttgcgcatatacgctctgtggaccagctcatgaaaacggcatgatattccatgcggatggcataacggtcatccgcgaaaccgattcctgcggggtctggccgaaaggtcgggccccgtttcgattgcgggtttgcgggctcccatatggcatcggtatcgtgcatgagtgcttcggcatgggcgccgaatgcgtcgaggggggtggcttgtagtgtggaggcatgacgaattaccagccgaattacgattcgaacaatccatatgggcggggattaagtgaaccgccgatgcagcaagagccgaaccagactccgtttgcccagccacagtatggtgactatggtgcgcagggcaatgcccagcaaccatatgcccagccgcagtatggccaatatgcccgagggagcggccagcagtacgggcagccggactacacgcagaacatgtcgaattacgctccgtatggccagtgcaaccaaagccagtacggcaatggttactcgccggagcccacgacatggaacggtttgtgcatcgcgggtttcgtgtgctcgttcctcgttccgattgtggggctgatcctgtcgatcatcgcgctcacccagatcaacaggacgggtgagaagagccgtggcatggccatcgccggcattgtgatcagcgtcgtcatctggctgttctcgttcatattcatggcgtccgggaacagcatcttcttctaggagcgttgcggcagacacacgggcaggggcgccaaccatttcttcgaatggttggcgcccctgcccgtgtgtctgccgcaacgctcctagaatcgcgctactccttcatcgtgaagccttgctccttgccgtagtcgatgagtgccttctgccaagcggccacaccttccgaaagcggctggttgccggtgtaggatttgccgaggtaatcaccgaagacaccacgggccttcacctcgaatggcaggaactgataccccgtaaggacgtccgccgaggcctgtgcgaggacctcgttgtacttttgaccgccgaagtagtctatttccttgccgtcggagttcttgatggtggtggcgttcttgaaatagtcggcttcgagggaggccttgtctgcggggaatgcgccggtttcgacgtgagttttcacgccatcgccatgagcgacgtactcgatgaagtcataggctgcctgagccttgggggaggacttgagcacggccagcgacgatcctccgttttccgcattggctttctccccattcggtgttggcatcagtgccacgcgccatttgcctgcggcagccggagccgaattgacaagatttccgggcatccatgcgccggtcagcagggatgcgattgtgccgtcctgcatgcccttgaaccagtcctcggaccatcctacggtcttcgtgtcgaggagcttctcatcaagcagcttttgccagaacttctcgaattccttgacgccattgtctccggtgaggttgattgtcacatccttgccgttattggtggtttggaatggtttgcctcctgcaagccaggtcatcgaatcgaagaagcctgcatcgccgctgtccgaagtgatgtagtattcatcgccgagggcgtgaatcttcttggccgcctcgtagtagtcatcccatgtcttgatcttctcgccgtccacgccggccttgtcgaagatctccttgttgtagaagaaggccatggggcctgcgtcgattggcaatgcgtacaccttgccgtctatttgcactgacgaccatggtcccggattatagaagtcttcgtatccgctcgtcttatctgtgatgtcaagcagatttcccttgatcgcatattggggcaatgcgtagtactcgatttgggcgacatcgggggcaccggaccccgcttcgatcgcgttgtcgagctgggtgtattccttcgtgttggttcccacgtttttcaggttgaccttgatgcctgtcttcttttcgtagtcggctgcgatttgcttgagcgaggggtcccatgcccacacgtcgatttccttgacgttgctttcctgtgatggttgcccgctgttcgaggagccacccccacaggctgccaatggtatgagcatggctgttgcgcccaggaaggcgattgcgcgtgtgctgaacttcattgttcttcctttctccatgttcgcgcgttgctccgttgcatgcattcgcgaaccttgtcgatgaacactgtagcaccgattttatgtttgcgcaaacatatgcgaaaaagcttaaaatcagtacatttgaagattgatgaatgcaatgatgtgcaacgtaaacatctattgtgtcgcacatcattgcatcatcgtgatattcggttgtgggtgttctgcctccgtgtgcgaaggtgtggggctgttcagcgcctgaacgccagaacgccgtttggctcgagggtgaccttgtcggtgctgtccgttgccaggctgcatatgagcatgtctccagcaggacggtctgcggtgacagtgttgcgggtgcggttgaacaggaattcgaagatggctccatcctcctgctcccgaaccacgcggagcacatcgccggcccgcgggtctgcatcgagctcgaatccgagcgccgcacatatctccggcaggctctggctgatgccgtccctgcccagcttgccggcaatgtaggccacgccgccttcgtggtaggggtgcacggtgatggcggccctaccgtccatacccgtggccggatccgcctcgaaggtggcgagcacggtggtgtcatcggcgattgcgtctatgacgtcggcgagatcatgcacgactgtgccgttgctgacgtcgaggtggtcgagcattcccgggaagagcgtgccgagtgggcaatgttcctcgatgcgaacgccgacgacgtcgccgatcaacccgggccagccttccgtgtgcagtcggtcgtgctcatcggccagtgcgctgtagtacgtgacgaatgccttgcctccattcctgacaaaggtgcgtagacgttcggccatctcctcactgaacaggtacacgcagggaatcaccacggcgtcatacgtatcccattgtgcgtggatgggtgtcacgtccgcggtcacgccgcgattggcgaaggcggcgaaccagtcgaggggctccgtccattcgcgtatgtgttgggtgggtgtggccgtatgctcggtggcccattcggactggatgtcttgcacaatggccacccgtgcctttgaaagcttcgagcgcagtatgccggcatcgctcaatgtgtcgaggtctgcgcccaatgcgcatacatcccggtagatctgcgaatgctcccctgccagtggcagcatggccgagtggaacttttcggcaccggaccgcgactggcgccactggaagtagcagattgcgtccgcgcccattgccagatgcagcatcgagtcgcggatgagctcacctggctccttgcgggggttgatctcgcgccaattgactgcggaggtggattgctccatgaggaaccagggcttcttccttgagatgccgtccaccagggaggcggagtatgccagttcgtcgatatgccagctgccgggggtgaaatagtgatcattggacacgaagtccacctcgtgggcccagtcatcgtagtcgagcgtgttctgcgacgcgctcaccatgaaattggtggtgagcggaatattcggcgtcacttcggacagcacgtcgcgttcggcgcagaagaactccttgagcgcgtccgagcagaagtgcttgaaatcgagcaggcgccccgggttggtgaagttgccttcgccgcccacataacgcggcggcaggatctcctcgaaggagttgagtcgttgggaccagaagttcgttccccacgcggcgttcaccttgtcgattgtgccgtaccggtcgcggcaccactcccggaaggcctgcacggcgtcatccgagtagtcgaagtagttatggcagccgtattcgttgcctacgtgccatgacacaatggccgggttgtctttgtaatgttcggccatttcgcggcataggcgcagggcgtatgtgcggaatgtcggactggtgggacgccagtgttgacgggctccgggccatatgacatggccttgctcgtcgcgccgcagtacctcgggatgtgcgctcgtgagccacatgggcggcgaagcggtggcggatgcgaggtcaacggctatgccggccttgtagagcttgtcgatgacgcgatcaagccaatcgaattcgaaattgccgtcactcgtctcgatgttcgcccagctgaagatggccagggatacgatgttaacgccagcctgcttcatcaggcgaatgtcttcgtcctgtacgtcttcgggccattggtcggggttgtagtccgcaccgaaccagattttccggtcgttgcctggcaggggctgtggccaacggtgcgcacgatgttgtgtggatgctgacatggagtcactccttcttcattggatggttgaacgcgaatgtgtcattccttgaccgcaccggcagccagacccgactgccaatacttctgcagtagcaggaacgccactacgagcgggatgatggtgatcatcgatccggtgatcacgaggttctgaatggcctgtccgcctgcggtggaggcctggtccttccactggttcaagccgatggtcagggggtaccagttcgcgtctttcaacatgatgaggggcaggaagtagttgttccatgttgccacgatcgtgaacagcgcacaggtgacgatgccgggggagagcaatgggagtgcgacggtgaagaaggtgcgcgcctcggaagcgccgtccacccgcgcagcctcaagcaactcggtgggcaccgcctgctcggagaagatccacatcaggtacaggccgaatgggctgatcagagaggggatgatcatggcccagggggtgttggtcagaccgagcttggcgaacagcaggaactgtggaacggcaagggcgatgcccggaaccgagatggccccgatgatcacggcgaagacggccttgcggcccgggaagcggaacttcgccaatgcatatcctcccatgatcgccagcaatgtggcgcccccggcgcccacgatcacgtagaacagcgtgttgaggaaccagcggccgaagatgccgtcctgataggtgaacacagtcttgatgttgtcccacagcgcaaaggtcttgccgaatcccagaccgaaggtggatgtgaagtccgcctgtgtcttcgtcgagttgatgaggatgtacaggaacgggaagaggcagtagatcgcgaagacagcgcatacgatggtgagcagcgttgacttgcggggatttgccacgttggtgaagccgttcttgcgactgcgcttgcgttccgcacgctcgtcctgggcgattctgcgctggcgatcgcgttctatcctgcgcgcattgcgggtgttttggatatccgtggaaactgtggtggtcatgtcgatctctccttgagtcttacttcatctggtccttcatgctgcgcagctgcacggcgtatgcgatggccatggtgatgatggccatgacgatcgccagtgcggcggcatagttgctttggtttccggagaagctcagattgtaggcgtacatgttgggcgtgtaatacgtggtgatggtgttgccgggaaccatgttctgcatgatcgacggctcgttgaacagctggaaggatccgatgatggagaagatcaccgtgatcgccagcgaacccttgagttcagggagcttgatgcttttgacgatctgccattcgctcgcgccgtcaatggacgcagcttcgtaaaggctgtggggaatggtggacaggctcgagtagaagatgagcatgttgtagcccgtgaactcccaggtcacgatattgccgattgccgccagcaggacgctcggggcgagcacgtcgatatgcgtgccgaaccaagcgttcagcgagccgaccagaccgtacttggccccgtacatgaatgcccagatcaacgtggacaccacggccggcaccgcatatggaaggaaggtggagatgcggaagaactttgtgccgtgaagcttcatcgagtcgagtgccagggccatgagtgccgccaggcatagcatgatcggcacctggacgacggtgaagatggtcacgcgtcccacggacgaccagaaatgcgggtcgtggaagagtttgatgtagttgtcgaatcccacgaactgcgtgccgccgatcatcttcgtctggaagaaggagatgtagattgcgtacaggatgggaatgatgaacacgaatacgaataccagggcgaatggccatagaaacttccagccccgccagtccgcgtgatgcttgttcacccgagccgatcctccggttgtcacggcgttcgccgcaatcgccgcggcatctggcgtgcccgctgtcccgggcgatttcgttgtagaagtcatcttgcctctcctttgaggtcccgtaccgttcatctgtgagcggtgcgtctgccttgcttgcgcttccgagttcgaactactgtgtccgcattcagaatgtttacgcaaacatagtacatcatcgttggaaatcaagtcaaattaagctcacattgtttatgagcataaaatgcatgattgcgcaaacagttgctatcattgatatattggcttcgacgaagattccatatttgtcacatgtcggcgttttgcgaaaagtgggtgagatatggcagggtcagtttcgatgaaggacgtggcgaggctggcgggcgtgtcgtcgcaaacggtctcgagggtcgcgaacaacagcagcgaggtgaagccggagacgcgcttgagagtcgagcgtgcgatggaagagcttgggtataggccgaactatgcggcgcgcgcgttgaagcatgggtcgttcaaggacgtgggtgtcgtcctgttcaatatgacgtcatacggtgattcgcacatcctcaacggcgttgtggatgcggcgagggagcatggatatgcgacgacgatccggtcgtttgaacaagggtgtcccgcgactttgcagagcgcaatcgaccagatgaaaacgctgccggtagatggagttgtgttcatcttggagcagcaagtggcggatttcaatacattcgtgccgagtgtcgagttgccggtggtgctcgtctcggaagagccgtcggaccattgcccgacgatcgattcagatcaatatgggacgtcagtggtgctggtggactatctgttggcgaaggggcatcgcaacgtgtaccacattgcaggcccgtcgtattcggtggcggcgcagagcaggcgacgtgggtgggaagatgccctgaggcagcagggaatcgttccgccgtccgtgtacataggcgactgggaggccgacagcgggtatcaggccggtctggcactggcgcatgaacgcgactgcacggcggtgtatgcggcgaatgaccagatggcgtacggctgcatcctcggtttgcgcgaggcaggcaagcgcgtgccggaggatgtgagtgtcgtgggcgtggacgattcgctgcagggcattgttccccggcttgagctgaccacgatgcgagagaagttcaacgagcttggccgtgaggcgttcgggatgatcctcgcccaatgcaacggcgacaagctgccggtgggggtcaagaccgtcattccatcggtgcttgtggaacgcgggtccgtctccgaggtggaggatcggggcgcgtgagcatggtctggctgaccgtgcgtcggtgatcggttgcttgcggcaggtgcaggcgtttgcaatctcgctatgtcgtgaccgatccgcggtcctttgcgaatccatcatattcgacacgccggatttgcgttgaatgcggaatcgagtaatatttacatctgttgtcgcgatggaaacatcgagaaacaacggccgcgtagctcagttggttagagcgccgccctgtcacggcggaggtcgccggttcaagtccggtcgtggtcgctaggtcttaatgattctagcgaatcttaagattgaggccgcgtagctcagttggttagagcgccgccctgtcacggcggaggtcaccggttcaagtccggccgtggtcgcgatgttggaaccctgttccagcctctggctctgtagctcagttggtagagcgaacgactgaaaatcgttaggtcagcggatcgacgccgctcggagccaccactcaatcccttgcttcggcaagggatttttgtttttcaggcccatctgccgcactattccatccgccgagtgccagatacgacaaagagcaggggcgatgcgaacgcgaattcacatcgccccctgataaggaccgctgagtggttactgcgcggttgtggtccccgtgattgaggaatcctcggattgcggtgcaccatccgggtcgaaggcggtattctcgtcgatctcctcgagaccgggaatgtcggtcggcgtctcctccacgaacttctcgatgcctggcaggtcggcaagcggatcgccttccttgcgcgcgagcttggcctgttcgcggaaccagatgcgcacggccggattgatgtctttcgattccaggtactggcggtagatcgggaacatcgcgtgcagccatgggtacatcaggtacagcgtgcgctccgacttgtgattgcgccaatgctccggatgtgcggcgaaggtgttcttgaaacgcctcatgtagttgcggaacgacttgaacgacgtatccatgcggcgtgcggagatgccgcagatcatacggccggaatacacggtcttgagtccgcggccaagcagatgcagcgagatgtcgatgtcttcgtgcatcacatcttccttatcgaggcacacctcgtcatgaatgagcttccatgccgaagcacgcaatgccatgttggagccgaacagcagcacctgaccgccgtccgcgcggtaagtgtggcggcgcacgctgtcgtcgccgcgcaatgcgattttgtgggcgggcatgtcgtaataggtgaccgggccggtcgctcccatcgcctcggcatcctcggtgaagatgccccgcaccacctccacccaatccggcttgagcatgcagtcggcatccacgcgtccgagaatgtcgccggtggcatggttgagtccgtagtttcgcgtcggaatgagaccctgctcctcatcctgatggagcagcttgaccgggaggtccggatgttcggcaatgtagcgctccacgatttccacggtatggtcggtggaacggttgtccaccacgagcacctcgtgcggcatcaccgtctggcgggttgcgttgtcgagacaatcgacgatgcgttccttttcgttccacgctgggatgatgattgagactttcagcatgccttctacaatatgagttcacccgtacactcgggcacacatacgatgatggcgaatttaggcgggtgcgggctgacgggtcgtgatttcgccctgaacgttgagtatgcggactattacaatattgcgcatgagcgaggaaagcaagcggaaactggacgtggcatcgctgttcccatcaaagggcgatcccaggaggccgccggagtggtatggccgcgcgttgttctatgccgtgatagccgtctacctcggttggtttgtattcacgtcgtacggcaagatcacgtacatcgtgttcgacatcgtgatcgcgttgttcctggctctggcggtggagccgttggtcattcgactgatcaggcacggttggaagcgtggcgttgcgtcggtgacctgcctggcgggtctgttggtcatcgtgatcgtgctcatggcgctattcggcaacatgttcgtgcagcagatgatctccatggtcaagggactgcccgatctatacaaccagttcgccgccttcgtggacgcgaaaacccatttcaagctgcccgagatgaacgatcttggcggcgagatcatgaagaacatcaagggatcgtgggtcaccgatttcgccggtcaggcggtgagcaccacgatgggggtgcttgggcagatactgaatctgacgacagcgctcatggtggcgttctacatctcgatcgccggcccgaagctgcgccggagcgtgtgccagtggatcgctccgagatctcagcgccgcttcctcatggtgtggaccgtggtgcaggatcagatttccgggttcctgttctcgcgttccatcctcgccgcgatcaatgcggcctgcatgtcggtgttcctgatgatcatcaaggtgccgtactggctgcctctggctttgttctgcggcattgtctcgcagttcgtcccgactcttggaacctatatcggtggcgcattgccggtgctgttcgcctggggtgagcgcggaatcggttacgccattggcgtcgtcgtgttcatcaccgtgtaccagcagatcgagaatctggtgctttctccgaagatctcggaacgtacgatggatctgaacccctgcatcgcattcctcaccgtcctgttcttcggctcgatattcggtgctgccggcgccttcctcgcattgccgatcaccgccagcatccaggtgctgctcaaggtggccatgaaacggtatccgctggtcgacatgccgttgatgagcgatccggagccgaacaagaagtcgaagatggtggaggctgcggatgcgatcaacgaacatgtgatcaaaccggtcagcgaccatatgccacgacaggccaagggttccagcgcgcatgtttccttcgacgacgaccatattcagtatctgcgtgagcagatgtacggcagtgaccgcgaagacgacgctgcgagcggacatgcccactctgaatcggaggaatcaccgaccatggcgattccgaagcacttgctcgaacgtcatgcaggcgaaggactccaacacaagccacgcaggggagttcccggcaagggcgagtcgcaaaatgaggtcgatatcgttcgcaagaccgataccgccgaatcttcgactccggtagaatctgagcggacggattcggatggcgcaaagccttccgccgccgccacaacaaccggaaccaaaccaaagaaccctaggagccagtggagctgatggcaatactcgacgttctcgatctgcttctcgtcattgtgggtggtgtgagcatcgcctaccagggattctgcattctcgtttccctattcgccaagccggtcacattcccggccgccccgatggacaagcggtacgcggtgctcatctccgcgcgaaacgaggaacaggtggtgggtaacctcattcgtgacatccaatcgcagagctatcccagcaagctcatcgacatctggctcgtggccgacaactgcgacgatggtacggcgcaactcgcccgcgacctcggctgccatgtggtggaacggttcaaccaacagcaggtgggcaagggctatgcactgacgtacctgctcaacgcgatgatcgattcgaaggcctccgaccaatacgatgcgttcttcgtgttcgatgccgacaaccgcctcgacaagcattacttcgaggagatgaacaaggcctaccaatccggtttccgcattctgacgagctaccgcaattcggtgaacctttcggagaactgggtgagctccggttcggcattgtggttcattcgcgaatccagattcgtgagcgcctcgcgcatgtggctcggtaacagctgccatgtgggtggcaccggattcatgttctcgcaggaggtgatgcgccgcaatcaggggtggaagttccacctgctcaccgaagacctcgagttcacgatggactctgtgctgcatggtgaccgcatcgggtacgtgggctcggcgatcctctacgatgagcagccggtcaccttcgcacagagctggcgtcagcggctgcgctggagcaaggggttcctgcaggtgttccgctattatggcccggcgctcgttcgccgtgcgatccaggaacgcgatttttcatccatcgatctgacgctgttcatctgcccgttcacggtgcttgcaatcattcgcgtcctgctcggcaccatcttcgccgcctgcgggttcatctcatggtcgagccagggcgccgcgttgttcaattggatgctcggcgtcgtttcgtcgatggtgttcatgatggtgctggcggggctcacgatggtggtggaacgcaagcagattggcgcttcgaaccgtgagttgttcgcctatgcgctgagcttcccgatttacattctgagttatgtgccgatttcgttccaggccgtgttcgccaaggcgcagtggaagccgatcgagcatcagggctcctcgggggccgaggatccgcgtattcgggagcaggaccgcgaggaacgcgccatggccagctgagtagcctgagcattcggtttgaaccggtagatcatatttcacccgattccaccaacagactgaaatagacagatagtctaaatatgtccatctcgtgagatggtccgatatggactgtctagattctgattaggtggagaaagaaaccgttcgtgagttcatttgtgaatgtaattgccgcgaacggctgattcttgatataggtgaaatatgacacagattatgcaacagccaattgccgctcctggtccggtgccggccgacccgtccatggcggtctccattcggggtctgtataggcggtatgacgacaaagtggctgtcaatggcctctcgctcgacatcccgactggttcgttctatggactggtggggccgaacggcgcgggcaagaccacgacgatcaacatgatgaccggaatgctcaagcccgatgcgggcatggtgctcgttctgggcaaggatgtctggcacgatgtcaacgccgtcaagcgtgagatcggcctcatgccgcagccagaccagattttcgacagattgacgggccgccagttgctcgtctattccggtatgctgcgcagcatgccgcgtgccgaggccctggagcggtccaacgacctcatgcacgcattcgacctgctcgatgcggccgacaaaccggtgttcgactattcggccggcatgacgaagaagatctgtctggccactgcgatgatccatagtccacgcgtgttggtgctcgatgaacccttcgaggcggtggatccggtgtcaagctcgaatatccgcgacattctctccgcatacgtctccaccgggggcactgtgatcatttcgtcgcatgtgatgtcgatggtggagcgcatgtgcacgcatgtggccgtgatcaacaaagggcaggtggtcgccgctggaaccgtggatcaggtcgccggtggtgaggatctcgatgagcgcttcctgcaactggtgggcggccgccatgacaccatgcatctcgactggctcaatggaggtgtgcatgcggctgacgaggccgtctccgtgccacaggatgaccatcagaacggtggtcaggcatgagtgcgacgcagacacctccgatggaagcgccgagagacgcgcaggtcactccgatgaatcgagatgccggaggcgagcgacccaacattgtcacgacaatggtgcggttgcgctggtcgctgatgttcgccgccatgcgcaaaagtccctggcaggtcgtgggatatgtgctggcgctcctcatggcgcttggcatcgtggttggggcgggcctcgccgcattcgcgctgaccggcggcgcggtggaatggaatgaggcggcgttcgccgtgctgcgggtggtcatggtgaatgccggcacggtgggcatcatcttcgccgcactcattcagctgctgctcatcggggaatcgtccaccatgagcgcgcagaagttctcgttgttcggcattggagaccgcacgctcaccgccggactctacctttcggcattcaccggtctgccggccacctgcgcattcctgtcgctgctgtgcgcctcgcgcctctacgtggggtacggcacgggcgccgtgctgggaggcgtgctgagtgccgcactcaccgtcatggtggccatgtgcttcagcaaggcggcactgtcgttggcctcacagctcacccgcaccgagcgcggcaagaacacgctgtacattctggtgacgctgctcgtcgtggttgcggcacaactgccgaacatctacgtcaacacgcataccgaggaagacttctcggcgattgacgtgaatgggctcgttcgcttgaccgacgttgtgggctggctgccgttcgggtggagtctggggttgccgttcgacgccgcccgtggcaatgccgccgcgtgcattgcgcgggtggcgctcgccctcgtgttctgtgccctgtgcttcgccgcatcggtgtggtgcattcgtcgcgaacgactacagggcgaaccgcagagcaacgtgcgtagggaacgttcgatcggtgcgttcaactggatgccggattcggcaagcggggcgatttccgcgcgcctgttcatctcgctcaagcgcgacccccgccaggccatgcagtatgtgctgcccgtgttgttcatagtgattttcgcgctgcaatcccatggcgagtcgatggtggtgtggcagtgcttcctgtggatgggactcatgatgctcatcggcgaaagcaacgggatcgcctatgacggccgcgcctacgcgatggagcagattgccggcgtgcccggcagagtggaccgctgggggcgcacccgtgtctacctggcctacttggcgatcttctatgtgctgtgcgcgttgctcacctacgcgcttaccggcgattggcgcactccggccggtgtcatgcgtggcatcacctgcacggtggtcggcttcggcgtagtgctcatctcgttgggtagcgccgagttcttctccacgttcctcatgtacccagtgccgtcgatcaggaaaccgttctcatcaccgcaaggacgcgccatggctcagggtcttttcccctttgccttcatgctcgccacctgtgtgatggcgctgcccacgggcattgtggccattgtgctcgcagccaccggtcactggggcatgaattgggtgctcatgccggtctcgcttgccaacggcgtgctcttcctgtggctcggggtatggcttggcggtaagattcttgatgcacggggcctgaaggtgctggccacgctcgacaacttcgcctcgttgcagcaatagcttcatctcggcgattgacggaaggcgcatgggcaggaaacaaacagcaggaaggcatgccacgaacggcacgcgtcgcatacgggcccgtcgcgcactcaccgtggccatcaccgccctcgtcaccttggggtgctgcggtgcctacgtgtgggccgacatcgccgacaaggcacctggaatcctcaccaatgccgccgtgcaaccgcatattgccgagccgcaggggcatctgctcacagccgatgcccctttcattgccaatgccgacacctcgcgtgccatcgatgccggggaggcggcgaagctcatcgacgcactccgcgcgaagaacggggtgggaccagacgtctcggcaatcatcatgcaggccgacggcaccgtggtggccgatcatgcggcggatgtggcgcgcgaaccggcctccacaatgaagacgctgacatcgctggccgcggcctcggtgctcgacatgggagacacactgccaacccagacattcctattgcaggccgaacagggcaccgacaccgtggtgatcaaaggcaatggcgacatgctgctcggtgccggcgacagcgacccggaccatgtgaacgggcgggccgggttgctcacgctggccaagaacacggcccatgccctcaagcaacggggggtcacgaaggtgaacctgcaatacgatgattcgttgttcggtgccgatcgcacgccaacgggcatcgaggccaacaaccccgattcgctctattacacgcctgtctcctcaatggccattgatggtggtcgccaatggaacggtgcgaatccaagaaacccggacgtgttcgagtcatacccggcgctttcgcagaacaccgcagctgatgtcactgccatcttccggaacctgttgggcgcccaaggcatcacgattgtgaatgccgagcccacgcagaccacggtgagcgctgatcgcacgccgatagccgaagtggagtccgcgccgctcgccatggtcatggccttcatgttgcggcattcggacaacacactcgccgaggagtttggcaggctgctggcgttgtccaccaagcaggagaactcgccggccggtgccaccgccgcggtgagaaacgaactgcgcacgctcggcatagacctgaccgggctgcagatggctgactgctcgggtctcactcctgggtcgagactcaccgcgaacacgctcgcccaagtgcaggcccgcaatctggatgtcgggggagcggtggccgcggcagagggactttccattccgggtctcgtcggtacggcagccaatcgtctggcctcgacacaggccgccggtctgacgcgtgtgaaaaccgggagcctgcaggaagtctcgtcgatgacgggcaatgtatcgcgggaacaaggcggtgtggccgcattcgcggtgatcgtgaacaatcccgaagacttcgaggccacgcgcaccgccatcaacgaattcgtggcggggctggcggccctgtaatccggggaatctggtcgggaacaggagatggtgaaagggcatccatggcatactctgcagctatgaaggcggcgatcggcgagatgcgcgatgtgctcaaagcccatggtctgggccagcaatccaaggaattctcggcacatggcgaacacaagccacatgacgatgccccgttcgtcttcgtcgcatgctctggcggccgggattcattggcgctggccgcatgcgcacaggtggtgtgcgccgcatggggcattcgttgcggcgcgatcatagtcgaccatcatctgcaggacgcgtcccataaggtggcgcaacagactgcccagacgtgcagggatctcggtctggagccggtgctcattgtggacgtgcaggtgaaggaacgcgggcagggcatcgaggcggccgcacgcgaggcgcgatatgcggcgctggtcggcaccgcacggcgatggcatgcgactgcggttctgctcgcccacaccaaggatgaccaggcggagagcatactcatcgatctgatccgtgccgccggaaccgatgcgttcgccggcatgccgcaaacccagctgttcgacgatgtgctggtattgcgccctctgctcggcatcacgcgcgcgcagacgacgcgaatctgcgaagacgaaggactggaatactgggatgaccccaccaacggcgatgcggtgccattagagaccgcgttgccggcaagctatccgctgcgctcgcgcgtgcggcacgacctcatgccatacctgagcgcattcgccggatgcgacatggtggatcgattggccagaacagcgcggattgcgcgccgtgatgtcgaagcgctcaatcaagaggccgagcgtgcgcttgcgcagacggtggaattcgaagggaatatgcgcgatctgcaggcagatcgtctcgccgatgacaagctcggtgcgaacatcgacgcgcgcgcgttggaacggtggcccgaggcgatacgctaccgtgtgatcgcccggaccttggctgcgtgcggtctagcatatgcatcacggcatgtggcggcggtggacaagctcgtctcgcagtggcacggacagggcaaggtcgcgcttcccagtaaatattcagcaaaacgtaaggctcacgtcattcgcatatgcgaagatattacgcatgcgaatcgtcgatgtgcaaaacgaaattgatcatgagctgatcactcatgacgagatcatgaagagaatccaggaagccgcggaccaggtcagcgaggattacaaacacacgctgccgctgctcgtatgcgtgctcaaaggcgcggcgaacacgatgaccgcgttcgcgcaggccatgtcgatccaggtggaactcgactacatgagcctgtcatcgtacggtgcgggcacttcatcgagcggcacgatcacggtgcgccaggatctgagccgcgatgtgcgcggccgggacgtgatcatcgtggaagacatcatcgattccggacgcacgctcgactggctggtgaatgagctgaagtcgcgtggagcgaaatcggtcgagattttcgcgcttctcgaaaaaccggctcgacgcgtgatcgatgttgatgtgaaatataagggattcgagattccagacgaattcgtggtcggattcggccttgactatgacgagcgatacagaaacctcgacagcattgccgtgctgaagcccgaggtgtatgaaggagctgtgcaatgacctaccccaatcagccggggaacaattcaggcggccgcaacaacaggccgaacccgtttaacccattcggcgacaattccaacaagccgcgcaacaacggcggccccaacgggaacaacaacgcccccaggtcgttctggcagcgcccgtggctctacatcgtgctcattgtgctgatcctgttcttcattttccaggccttcctcggaaacaacacgcagacgatcaacacgcaggatggcatgaacatcctcaacagtcaggccagcgacgtggagtcggccaccatagtcgacaacacgcagcaggtgcagttgaagctcaagaacgacttcaagaagaacgacccgcagacggggcgtgagcgcaattacggcaaagacgtgcagttctactacaccaccgcccagcaggcgcaggtggtgcgtgccgtggagaaggctaacccgtcgcagggctggaccgccacgatgcacagcacgagcatgtggacctacttgctgagctcggtggtgcccttcctcattttcttcgcgctcatctggttcctgatgagccgtatgagcagctcggcgggcggcatgctcggcatgggcggcaagaagagcgccaagctcgccgacggccagattccgaagacgaagttctccgacgtcgcgggcgaagaagctgccgtacaggaggtcgaggagatcaaggacttcctcaaggacccggccaagtacaaggcgctgggcgcccgcatcccgcgcggtgtgctgctgtacggccctcccggcaccggcaagacgctgctcgcacgcgccattgcaggcgaggccggcgtgccgttctacgccatggcgggttccgacttcgtcgagatgttcgtgggccttggcgcctcgcgcgtacgtgacctgttcgacgaggcgaagaagaatgccccggctatcatcttcatcgacgagatcgacgccgtaggccgcaagcgcggctccggcatgggcggaggccacgacgagcgcgagcagacgctcaaccagctgcttgtcgaaatggacggcttcgacaacgacacccatctgatcatcatcgccgccacgaaccgccccgacgtgctcgacccggcattgctgcgcccgggccgtttcgaccgtcaggtggccgtggaggcaccggatttggaaggccgcgaggagattctgaaggttcatgccaagggcaagcccttcgtgcccgacatcgacctgcattcggtggctgtgcgcacacccggtttcactggtgcggatctggccaacgtgctcaacgaggcggcgctgctgtgcgctcgagtgggtgcccagctcatcgacaaccgtgccatcgacgaggccatcgaccgtgtgatgagtggtcctcgccgccgttcgcgcggcatggcgctcgacgaactgcgcaacaccgcgtaccacgagggtggccacgcgctggtcgccgccgccctgcacaacaccgacccggtgacgaaggtgacgattctgccgcgtggccgtgccttgggctacacagccgtgatgccaactgaagaccgttattcgcagtcccgcaacgagctgctcgaccagatggcctatgcgatgggcggccgtaccgccgaggagatcgtgttccacgacccgaccaccggtgcatccaacgacatcgagaaggcgacgcagatcgcacgtcagatggtgggcctgtatggcctctcctcccagctcggcgccgttaagtggctcgattcgaacgacgaccagggtcttgacggtctgcgcccgcgcgagtattcggacgccaccgccgagatgatcgacgaggaggtgctcaagctcatcgagaccgcccacaccgaggcctggcagatcctcaccgagaaccgcgaggtgctcgacgaactggtcagccgccttctcgtcaagcagacgctcaacgagaaggaactcaaggagatcttcgccaatctgaagatggctccgaaacgcaaggtgtggttgagcaacccgaaccgcccggattcggacaagccgccagtggctattccggaagcgttgaagaagtccgccggactgcctcagcaggagttctaacgaaaacccggaaggtctggagcgcatagcccaggccttcctcgcatatgcgcccatgcgaacagggaagaggagggcgaggaatatgacaaccgtggactgcagcggcatcgacctgggcagcaacgaggacgacatgcgtgtgtggacggcggacgtcagttgggtcatcgacgacgaccagctggtggatgccgaggatctggccgcacatgtggcggccatcgggcagatgatgctcggcgtgcccgtcgaacagcttgccgagcgcatcgcggcgcagctggcgaaccaatcggtgttccgctccgtcactgtcaccgtgcacatgcattggaaggccccattgcgcaccttcgaacagctcagtgcaacggtcaccgcaaaccggcaatcctcggccaacccatctgctgccgctgcgaataccgggggcgaggaatctgcaagcacgcatgatggggcattgccggtcgacccgtcataccgcgatgccgtcatttctttgcatagtgccgcgctgaatgccgagcagctgttccgtgaggtcatcgtcacactcgacagtatgccgggcaaccaagtggacggcatctccccactgtatttcgtgggctccctcaacgggaccgacggccatgccgccgtgattaaactcagcaccgcaatgggagtgcgtcagctgaatcaggtgctcgatgcgctgcacaccacacacgagggagccgtgcagctgtcggttgtggccacaggcaaagtgggggatgaatcactgcatgcaccgaaaggtgcggcggatcatcatctcggcgctgccgtgcttgagccatgggctgccatggatcccaatgccagctataacggagacccactggcgtatctgctggcaatggcgcccgacagcgcacaggtgggcgtcgaatccgaacggtgggtcatgggaggcggccgatgaaagcacgcagaactccatggtggtggtatgtgatcgccatgctcgtcggtctacttgccggcatgggcatctcgcatcttgaggagacgcgcgggctgggattggccggcatcccgtacctcgccagcgcggtgatggtcgttgtcggcttcattgtgctctatctggcgtggcaggtgcacaaatacacgaccaccgatccgaagaaacgtgcgcagctcaagcccatggattcggagcgctgtgtgaacacgctcatcgtgtccaaggcgctcgccattgccggagcattgctcgccggctggtatggcggccagatcgtcatgctgtacgatcgttttgaggcaccgttcttcagacatatcgtcatcgaatgcattattgcggtgattgcgagcgtcatcgacatggtgctcggcatcatcagcgaaggactatgccagctgccgccgaacatgggaccggagcatccgaaggtcgtgcgcaaacgccgtgaggagcggttggcgaggttcactaacagggcgtctggcttgccgatgcaggccgcagggcatcatgccggcaataacggggccgatgagagcgacaagtgggagaagccctgcaattagttggcatatcgactgagacgtccgtgctctctcgactgacagacaggcacacaatccggcagagggtcagtctgtctgcgggacgcgaatcatcgcctcctgcaccatgcacgccacgagatcgccctcctgggagtacacctttgccgaagacagcccgcggccatgggcggcagtcggcgtgtcctgcacatacagatgccacttcgtcacgtcgatgtcgcgataccaccacatcgaatggtctatcgatgcgaaggaaatgcccggcgtgagcagtgtgagaccggcacgacgcagaatgggctcgagcatcacttgatcgcagccgagtgcgagcaacgcgcggtggaaggtctgcgagacctcgatctcacccatggcacgcatccacagcatctgcttgccggtgtcgagtctgtggctctcctcatcggggccgagcacaatcggcgaggagatgtagcgaatgtcgaatggcgacgtcgtggcgtagtacttcgcgtagtcggactgatccgcatacggcttcatgagatccaccgagctgggcagtgactctgggtccggaacatcggccggcatggggtcgaaatactcgacacctggctggtccttcgtctggaaactcgcaatggccgtcagaatcgagccctgcgactgcgtcacattcacacggcgcgcggagaaggagtgcccgtcgcgcagattctccacatcgaacagcagatcctggtgaatgtcgcccggggcgatgaaatacccgtggatcgaatgggggagacggtcttccggcaccgtcttcgatgcggcgatgagcgactgcgagatcacctggccgccgtatacgcgaccggtggggaagtacatgctctcgccgttgatataggtatggtcacgatattgcgacggctcgcccagtttgagcacgtcgacgattcgttggagcggggtcttggtatcgcttgccatgttctgccttctcgcatgccatgcagccatgcacgtgttgcatgcaacacgtgggtaatctgctgttctatgtcaatgtgagtaatctacatggcgcgtgttaagaacgggcaaaagaatgttacgaaaagcgtgatacccgtatgcggccagacgcaatgccccgcaaggacgaacgggaaggccgacggcctccccgttcatccgtgtgcgacaatgcgcgtgcagattccgctgctagcgcgtgagcttgcggtgcaagcggtgcgggcgtgcggcctcctcgcccagacgggcgatcttgttctcctggtaggcctggaaattgccctcgaaccagtaccaattggccggatgctcgtcgtcgccctcccacgccaggatgtgcgtggcgatgcggtcgaggaaccagcggtcatgggagatcaccacggcgcagcccgggaactcgatgagcgcgttctcgagcgactccaacgtctcgacatcgaggtcgttcgtaggctcgtcgagcagcagcagattgccgccctgcttcaacgtgagcgcaaggttcagtcggttgcgctcgccgccggagagcacgccggtgagcttctgctggtcggatcccttgaagccgaagctggccacataggcgcgggtgggcacctcgacgccgccgacctcgatgaaatcgttgccgtcggagaccgcctcccacaggttcttgttcgggtcgagtccggcgcggttctggtcgacgtagctgatcttgacggtgtcgccgatcttgagatcgccgcccgacagcggttcgaggcccacgatcgtcttgaacagcgtggacttgcccacgccgttcgggccgatcacacccacgatgccattgcgcggcaacgtgaagctcaggtcgtcgatgagcacgcggtcgccgaaggccttgtgaatgtgctcggcctcgagcacggtggagcccaggcgaggtcccggcggaatctgaatctcggagaagtcgagcttcttggagttgcgtgcctcctgctccatctggtcgtagcgctcaagacgggccttgttcttggcctgacgagccttcggtgaggacctcacccattcgagctcgttcttgaggcgcttggcgagcttggcgtccttggcgccctggatctccatacgcttggccttcgtctccaaataggtggagtagttgcccttgtacgggtagagctggccgcggtccacctcgcagatccattcggccacattgtccatgaagtaacggtcgtgggtcacggcgatcacggcaccggggtactggtgcaggaacttttcgagccacagaatcgattcggcgtccaagtggttggtgggctcgtcgagcagcagcaggtcgggggcctcaagcagcagcttgcacagcgccacacgacggcgctcgccaccggagcacaccgacaccggggtgtccggatccgggcactgcagcgcgtccatggcctgttcgagctgcgagtcgagatcccagccgttcgccgcgtcgatctcggtctgcagcttgcccatctcctccatgagggagtcgaagtcggcatccggattcgccatctcctcgccgatctcattgaagcgcgcgaccttggcagccacatcgccgaatgccatcttgatgttctcgcccacggtcttgtcttcatccagagggggttcctgctgcaggatgcccaccgtgtagccgggggtgagctgtgcctcgccgttactcaccgtgtcgagaccggccatgatcttgagcagtgtggatttgcccatgccgttcgggcccacgacgccgatcttggcgcccggtaggaaactcagcgtgacgttgtcgaggatcacgcgatctccgtacgccttgcgggcgttgatcatctgataaatgaattctgccaacttgattccgttctagtaacgcatgcgatgtgcatcgcagagtcttacgcaaatgcacgaccattattccaaaagaggtctacagcgcaaacaccgcgcaaggcattgatattccgaaccgcagccaatctgcgcacaatcgttcaaacaccagatatactgggcgaatgcagcgaacgattgtcaccgataccagctttctctcacgtcccagcgaccccgccgacccagccgacccgctcgacgccgccattgcgcaggatctgaaggagacgctcgccgcgcaccgcgaagaatgcgtgggcatggcggcgaacatgataggcgagccgaagcgcgtgatcgccttcgtcgacgaaggcctgggcagcgcgatcactgtcatgttcaacccgcagatcactgccgccgacggtgaatacgacgcctgtgaaggctgcctctcgctgcatggcgagcgccacacaccacgtttccgccgcatcgaggtcgattacacgacacgcaagggacgcgctcgccacgccaccttcaccgactggaccgcgcagatcatccagcacgagatcgatcactgcaacggcgtgctcatctgaatccgagatctgcacatttacgcagcgccgctcactcgccgaagacggcgtcgagcgcttgtcgaaggtcggcaatgatgtcgtccggattctcgatgccgcagctcagccgcaccagatccacgcccacgccggcctcctcgagctgctcctcggtgagctgacgatgcgtggtgccggcagggtagagcgtgcagctgcgcgcgtcggccacatgcgtggcgatggagatcatcttcagatggtcgaggaaggcggagaccttctcacggccgccgggcacgccgaatgagatgacgccgcacgtgccgttcggcatgtacttctcggccagggcatggtagcggtctgtgggcagctccgggcaactcacccaggagatgcgcggatcgtcttcgaggaattgcgcaaccgcgcgggcgttcgcgcaatggcgttccatgcgcacgcccagtgattcgaggtgcatgcccatgatccacgagttgatcggcgccggcgtggagccgaagtcgcgcatgagctgggcggtcgccttcgtgatgaatgcggccttgccgaagtccttcgcatacacgacgccatggtaggagtcgtccggcgtgcacagcccggggaatttggcggagtgggcgagccagtcgaaattgccggagtccacaatcgcgccgcccacgcatgaaccgtggccgtccatgtacttcgtcgtggcatgggtgacgatgtcgacgccgtattcgaacggacggcagttgatcggcgtggggaacgtgttgtccacgatgagcggcacgccgtggctgtgcgcggccttcgcgaacttgtcgaagtcaagcacgatgagcgccgggttcgagatcgactcgccgaacaccgccttcgtgttcggctggaatgccgcctcgagctcctccggggaacagtccgggttcacgaaggtgcaggtgatgcccatcttgcgcatcgtcacgttgatgaggttgaaggtgccaccgtagatcgcgctcgatgcgacgatgtgatcgccttcgttgcatatgttgaacaatgcgaagaaattcgccgcctgtccgcttgacgtgagcatggccgccacaccgccctccatctcgcagatcttcgccgcaaccgtgtcgttcgtggggttctgcaggcgcgtgtagaagtagccggtctccgacagatcgaacaggcggctcatctgttcgctcgatgtgtatttgaacgtcgtcgcctgaatgatcggcggtgtgcgtgattcgccgttgcccggctggtagccgccctgtacgcagatggtatccacgtgctcgcccatgcgtgctctcctgtctccttgaagccacctggccgccatgccttcgacgtaggcggccgccctctcactggggttgacaacaatctagccggttcgcgcgtgtcgccgccgtgtcgttcatctatgtggacactcgtccacgcaggtggattccacgtggtgccatcgcgcttgccgaaatatgggatgcaatttaagatgattgaggcgcatccgtccgagtcgcgcaggtcaagacgcgccatattccgattctgtgtgcgaccatgtatgtaataaggagccatatgtctaccggcatcacccaatcaccccgtccatcctcttcccgattccgctggacgccggcggacattgcccttggcgctgcgctgggtgtgggctgcggactcgtcttctggggtttcaacttcgcctacaccccgatttcatcggtgcttggctccattctgcctggcattgcgagtgttctgcacgccgtgtggtatttctccggcacgctcgccgtgctcatcctgcgcaaaccgggtgctgcggtgtatgtgaatgtggtcggcagtgcggttgaaatgctgcttggaaacaacttcgcatttggattcgtattcatctcagcgattctgcagggcgttttcgccgagatcccgttcgctgcgacccgataccgcgtgttcaatctgcccatggccgtgctctccggtctgtgcaccgcgctggaatacggcttctacttgctgttcttccgctatcagggtgtcgcattgctcagcccgcgtggcattgtgcacatgatcagcgagctggtgggcggtgcgctcatcgccggtgtgttcagttggcttctattcgtcgctgtggccaagaccggggctctcgaccacttcgcttccggccgcgcggtgcacgtgcgtgaagagtaaacgaggattgcattccgtgcctcctcgccgattgtggacgctttgcgacagtcagccgccccatggggcggctgctttgtttttggcggaagcttctgtagaatgcttgacatatatccgatgcggtgctcatgttgttcgaaatgcgggcagaacgttcttcaatgggagatggacggataccttgtgaactgttcagctcgtagcgaatccgtgtgattggcatcggtgcatctggcaagcagtaccggtccgagacgtggggcgatgaggaagtaactgtggacgataagacgatcatgtatgcaggcaatgaggccggttctcaaaccgaactcatcaatcccaacgaaatcgcggcaatgggacgccgacctccgacatcgcaccgacggcagccggacgacgatgatcgtggattctacaggcggcttgccgtcacctgtgtgagcatactcgcggtgctcgccgtgctcattgcggtcattttcggcataggacgccaccgtcaatccataatcgctgcgaaacgtacggaatgcgagcgctcgctcgtcgggctcgacgacaaggtggtggcgtaccaagacctcgtgggtggcgacggtgaactggcgagcaagatcgccgatgtcgacgtcaaagacatgacggtcgtcaagcagcttgatattgagatggccagcgaatccccggcgacggtgaactgcgatgtgagcagtgtggaggaatttgagaaccgcattgcgcaggcgaaggcatcgtcccaatggtacgacgagcacaccgcttcgctgagaagcgccattcaggcagtcaatgagtcaaggcacgccaagcaggcggaggacgcccatgcctcactcgaggaggtgctccgtaatgccgacaacattctcacctccgcacagggtcatgtgacggatgaagcagtgtgggacgacctctccaagctcattggcgaggcgcggaaccgcagcggagaaaccgatatgggcaggatcggcacgctcatggacgatctcaacgccagaatggatgccgtggagcgttcgaaccgagagaatctgcggcaggaggaacaggcgcgtgcggaggccgaacgcaaggctcaggaggcggagcagaagcgcaaggaggccgaggccaaggcgaaggcggaggaggaaaagaacaaggacaagcactgaatgggccgtgccgcatgtcgttctgccacggcggtcttgggtgctttggtagactattggacttgtggtggttccgcaccgcacatggggccttagctcagtcggttagagcatcggactcataatccgccggtccagggttcaagcccctgaggccccacatggtacaaggccgtctccttcgggaggcggccctttgcgtgcatccgttgctcggttcggagttcgcggcgttggtcaggactcctcggcacctagtgtgccatcctccggctcatcgatgtcaacccagatatccgaatctggttggaacgcataggggcccgtattccgcgggtcggcgtcgtaggcacgcttgtcgcgcacgaaggagatgtggcgcaatgccatgaatttcatgaggcaatcctccatttgggaaagatcgtcctccaagcggtcgagttcgtcggtcggcatgagattgatactcgaattgctccatgtcgtgcagttgcgcatcgaatacttcactttgcgtacatggtcctggtagatttcctccacgatcgcgtgcgcctcgagctcgggcgtcgagtccgcggaagcctgcgctcgcatatgtgcggtttcgtcgagcgacatgccgaacagcgcattgcaccaaccgcgtagggtctgcagatccacgtcaagccgtgccattgcctgctcctcggtgcaggtaggtggagggggcgtcagattgtcggcatcgcgcgaacggcgtacctcgtgctcacgttgtgcgcgatccacgttgccggggcgctccggcgagccatagaaccatacgggtcgtccgcgcagaatgcgctgaagggtgcgcgaaggggtggagatgtcgggtgtgatgcgaatggaatcggctgggtcggtgaaatcgagaatgtcggcgagcctgagtttggcgtcgctgatctggttcagcacgcacaatatgacgagcgtgagacgaatgcccgcagtcgcctggcccttttcaatcacattgagcgtgcggtcgccccaattcatgccgtatgagtgcgcgcatctcaggaacgaatcggcgtcgatgccatacaattctcgatatcggtgaagaaaatcccctaatacttcgctaatctgtctatcggccatacgaggtacattaggcgatacagacggcgttcataatacattttgggttttgttctcggcgtgcagacagaatacgtgtaggtaaatattctacaatatactcagggaagataataatattttatattcagacccccacttacctaaattaattctattggattgccggtgcgcgtagatgagtatgccggaaggataaccgatcggaataaaccgtgacgtgctcgtattgtgggtcttggtggacgaaagcccacttgcgggcgccatagcggcgcgcgcaaacatagccggttcaccgcttgcgtatgcgtttgcgtatgtgagtggacccgggtcccccgtatctttaggagacgatgttatgcagcagggtattcatcctgattatcacaaggtgaccgtcacgtgttcgtgcggtaacacgttcgagacgcgttcgaccgccaagggcgaccatatgacggtggatgtgtgctcgaagtgccatccgttctacaccggcaagcagaagattctcgacaccggcggccgtgtggcccgcttcgagaagcgctacggcaagaagaactagtcggtccctgtgacagagaagcgccaggcaacactggcgctttttgtttgcctgcggacttttcggaacgttggtcggtgtggcgaggaaatcgatctgcatggatgtgtggcatgagcgaggagtgctggaattccgggcgacacgctaaaagtcaatccatttgacatatatagtattttcgttttactataacaccatgaacgcggaagcgttctggacaaatctgaaatggcgtgggatgcccggtgcgactcgcgtcgaacagtgaaaatgattgcaaaggagtagtcatggcaggtctgtgggacatcgacaagatcgagtatgtcggtcgcaccaaggggcttcaggagggactcggcttccagtattatgacgccgacaaagtggtcgccggcaagaagatgaaggactggctgcgcttcggcgtcgcatggtggcacaccttcgacgcgccgctcaccgaccccttcggtgacggcaccgcccagcgcccgtgggatggcaagtattccgacccgatggacaacgcgctcgccaaggtggactacgcgttcgagttcttcaccaagctcggcgccgagtacttctgcttccatgaccgcgacatcgccccggaaggcgatacgctgcgcgagacgaacgccaacctcgaccgcgtggtcgacaagatcgaagagaacatgcagtccaccggcgtgaagctgctgtggaacacctcgtcgctcttcaccaacccgcgcttcgtggcgggcgcctccacctcgccgttcgccgacgtctacgcctatgccgcggcgcagctcaagcactccctcgagatcggcaagcgcctgggcgccgagaactacgtgttctggggcggccgcgaaggctacgagaacctgtgggtcaccgacatgaagcgtgagcaggagcacatggcgaagttcttccacatgtgcgccgactacgccaagcagatcggcatggacgcccagttcctcatcgagccgaaggccaaggaaccgacgacgcaccagtacgacttcgacgcggccacggcatgcaacttcctgcgcgcctatgacctgatcgacgtcttcaagctcaacctcgaaggcaaccacgcgaacctcgccggccacacctaccagcacgagatccgtgtcgcgcgtgacaacggcgtgctcggttcgctcgacgccaaccagggcgacatgctgcttggctgggatctcgacgagttcccgaccaacctgtacgagaccacctccgtgatgtgggaagtgctcgatgaaggccagatcggccctcacggcggcctcaacttcgatgccaagccgcgccgcacctcgttcagcgccgaagacctgttccgcgcgcacatcgccggcatggactcgttcgccgccggcctgctcgtggcagacaagatgcatcaggacaagtacatcgaggacctcgtggccaatcgttacggctcctacgattcgggcatcggtaagtcgatcgacgacggcaccgcgaccctcgaatcgctcaacgactacgccatcgacatgccgcagtccgagatcatcgcatccacgcaccccgatcacctcgaggacgtgaaggcgaccatcaacaactacatcatcgacgccctggccaacgcctgacgtcacacggtccggccgtctgccgcatggacggccggaccgtccacccaacctctgcggtgcgcggcatatgcagtgcacgccgtatggcatatgccgccagtattcttcctttccttccttccaatgaatcgccgcctgttctttcctttcctctgcaggcgcgatgcaggcccagggccatcgagccacaccgtgcacccatacgctccgcgcgcatccttcccatcaaacacaccgcgcgcgggggagcacggcggttcccggaggcccatgggctttttccatacgggcgggcacgacggtgtgtttgcccttttgcctgcgcaagacgcgaggcacatggcgcactgccgaaccgaatgtactggtatgatcgaccactaccgatatggaggaccacgatgaccgcaacgaccgcgaccatggacatcaccaatcccgtactgcggggcatgtaccccgacccaagctggatgtgggacgagcgcggggagcgagtggccctggtgaattcctcgttcgaactggtgccgggactgccgatccacgtctcggacgatatcgcgaactgggagcttgcggggaacgccgtcgacgaggcgatggcgcaacggctgctgatccccttcgtgcttgattccgggggattgtatgcgccgacattgcgcatgatccgcgggaagtacgtgatcgcatgcacggtcgcccgcatcgatctggacgcggccgatgcagctggggtcgacccggagtcgatcgaggcggcccgcacaagccaaggcaacttcatcatcgaagccgatgcgcttgagggaccatggcgcggcccgtactggatcgagggcgccgaggggatcgatccagacatcttcgaggaccttgacggctccgtgtactggacgcagacaagaccggccgtacgcccgcgctgggaagggcagaccgaggtgtggacccagcggattgacccggagacgtggcggctgtgcgcgtcgcatgacgcagacggagactacggcaaaacggtcctctggacgggatacggcgtggaggcggtgtgggccgaagggccgcacctgtaccgcatcggcgattgggtatatctgatgaccgcggaaggcggcacaagcttcgaccacagcgagatgaccatgcgcacgtgggcacccgacgggctcggacctgcgatcgaatccctgcagggccaagcgcatgcggacgggaccgagccgcgcgcgccgcgtgccgacgaacggtcggttgtggggcggtatgcgcgactgttccatccgtgcaagaagaatccgttcctgacgcaccggcatctgggtttggaggagcgcgtgcagtgtgtgggccacgccgatctgctgcatcatccacggctcggctggtgggtcgcgtgcctgggttcgcgcgagacccccaccgcggaccatggggcgctcagtttcttgggcagggagacctttgtggcacctgtcgagtggcagcacgatccggcgcaatggtcattggaatccaatgggcccgcgcaaaggcggaccgatgacccgggctggccggtgctcgctggaggagcggggcgtctggcgcagacattgcgcatcgatgcggcggacgggaccctgctcgacatgcgcatcgggccgtgcgaatcgcaggctgtcgtcgatgcgcgcatgccttttaccgtcggcgagggcgaagccgcggccgtgcgcgcggatggcgtggtgtaccggcgtatgcctgaagacagatgcgtcgtgctgtgcccaccgcgtggcacggtgcgcatccggcaggacagccgccatacactgagcgtggcgaccgatggggcgtcggtgcagtgggcgctcggcgagggaccggagcgcagggagggcatggtgccgatctccgaaggggagccggggtcggtcatgctcgtcttcgacaaaggcatggcgcgtgtggtcgtggcgcagtccgcggaacaggcatgggaggcgccggccgtcgaggtgatcgacgtggcgccgctgagcactgaatggtccggaggcttcgtggggtgcctcgtcggttgtgaagcatagggtgcgggacgttcagtgcaggtcgtgcgtactgttgcgcactacaagtgtggtgggcaggatcacatggtgttgcgtggggcgtccctccgccgtgtcgatgagcatgcgcgtcgagaccgccgccatgtcgtgcaagggttggcgcacggtggtgagcgccggacccaggaaggcggatgtctgcacgtcgtcgaacccgacgacagaaaggtcttcggggatgcgcagccggttctgccgggcggcctcatagacgcccatcgcctgcaggtcgcttccggcgaagatcgcggtggggcggttcgggttctccagcagcgccatcgcctgcgcgtagccgccttcggtcgtgaaatcaccttcggtcaccagttcggggtccagctcgatgccctgttcggcgagggccgacgtgtaaccgtcgagccttgcgcgcgaacacatcatctcttcggggccggtgatgatgccgatgcgcgtgtgcccaagcgcgagcaagtgacgtgtcgcgagcacgccgccggcccagttgtccgcctgcacggagaagtcgtcgttcgatggctcgcctgaggggtcgaagatgacgtaggggatgccgttgtcttgcaatctgcctttttccctttcggtgagattggcgaagatgaagatgacgccgaatggcttgcgcctcaacatgccggtaatccagtcgtcgtcggggtgctggcgtgtgccgctttccgtcgtgatgacgctgatgtcgggggagtgccttgtctcacgcaacacgccgcgcagcacttcgagcgcccagattgtgtcgaggtcctggaagaccacttcgatgtaccgttgtccggccgttttctggccgcggcgttggtaccccgtggctttgagcgcccggtcgatggctgcgcgggcttcgtccgatatgtcggaacggccattgagcgccttggagacggtcgccaatgagtagccggtgtcctttgcgatgtccgccaatctgactttgggttccgacatatggagctcctttgtcgcaaatgaatgggtgtgataccatatggcataatagcgaaagtttcgtaatgttgcaaacgaaataggacgtttgttgtgaaaacggcaagcaaatatatacaaaagtgcgcgaaacgccgaaaacacacttagtttgactaattgacaaagtaggtttacgttagtttctaacgaaaacaacgtaagttttcgatagttctcaatgttgcaccagagcttcgtagaagctcggatgaattgccttccggcgatttgtgccagcgaggacggctccacgtcaatgtcaacgtggacaaagatcaaggaggaactatgaaactcaagacgtttgcagcagcgacactggccgttgcgaccgtaatcggcatgagcgcatgtggcgggtcggagtcgtcgtccgatgacaagaccatcacgttctggcacaatgcttccgccggtgagggccgccaatactgggagaatctggcaaagtccttcgaagaggccaacccggggaccaaggtggagatccaggccattcagaacgaggatttcgctggcaaactgcagaccgccatgcaggatcccgcatccggtccggatgtattcatgtcgcttggcggcgccaagaccaaggagatgatcgacgccggtcaggtcatggatctgaccgataagatctcggacacggtgaagaccgacatgaagacgaccctttccgcggccacgttcgacggcaaggtctacggcgtcccggtcagcgtggaaccgggcggcatgtggtattccaaggatctgttcaagaaggctggcgtttccgatgtgccggcgacctacgaggaactgctcgcggacgcgaagaaactcaaggacagcggcaccgatgccattgcgctcggcgccaaggatgcctggcctgcggcgcattggtattactggctggtcctgcgcgagtgctctcctgaggtctacgacaagagcgttcaggaccacgacttctcgaacgcatgctgggtcaacgccggcaagaagctgcaggagctcaaggatttgaaggtcttcaacgacggcttcctgaccacgaccgcgcagcagggcgccaactcctctgccggcctgctcgccaaccataaagcggccatggaactcatgggcgcttgggagccgggcgtactcaaggacctcacccctgatcagaagccgatggctgaccttggattcttcgcgttccccgaggtcgccggcggcgaaggcgagcccggtgcactcatgggcggcgtgacctacttctgcgtcaacccgaaggcttcgcagacctcgatcgacttcgtcaactacatgggcgagaagaagaaccaagaggattacgccaaggcgttctccaccatcccagcctccgagccagcccgtgccgtggtgaccgacgagtcactcaagcaagtcatcgaatatctggacaaggctccgtccatgcagctgtggatggataccgcactgggcaccaacatcggcaatgcattgaatgccgctgtggtgaacatgctgtcggggcagggcagccctgaagacatcgtcaaggcgatgcaggacgccgcccagaagggctgatcgcgtccgagcaaggtccgggatggctgggctgtgcccgcatggtccagccatcctttcccctggatgacgtacaacgaaacaccttagatacatgggattgatgacatgactgaaatgaatgatgccgtggcagtcgggcgaccggttgccgaaacgaagaagcggggcggagcacgcaaaccctctaacggcaaggggcgcagaaatctcgaaattttcatcctttccgcacccgcgatcatcctcttctgctgctttgtgatccttccgatcattctgggagcttactacggtttctaccaatggaagggtttcggcaccccggccgagaacggcaagttcgtcggactgcagaactacatcgtggcgttgaaggatccgaacttccagcaggcgattctgcacacctttgaaatcgtcattgggtccctcgttatccagggcccgttggccatcctcttcgctctcctgctcaaccagaagttcaaggggcgtggcctgatccgtacgctcatcttcgtgccgtatgtcgtttcagaggtcatcgtcggtaccggctggagcctgctgctccagaagaagggcgcagtcaaccagatccttgaatcacttggcatgcatggtgtcgattggctagccaatcccaaggtcgcgatctggaccctgctgctgctcatcagctggaaatacatcggattcgccgtcatcctcatgcttgcgggcatgcagtcgattcctgaggaactgtacgaagcggcaaaggtggacggtgccgggttctggcagatccagaagagcatcacattgccgttgctcgccccgacgctgcgcatctgggtcttcctgtcgatgatcggttcgctgcagctgttcgatttggtctacatcatctggggccagtacgtttccacgacggccggcgtctccacgatggccacctacatggtccgtgagggacgcggtgcaggcaactacggatatggctccgccgtcgccctcatcattttcgtcatttcgctgatcgtggcgctgacctaccagcactttgtgctcaaccgtgatctcgacggcgccttgaccgagaagaaggcgtccaagaagcgcaagaagaggcagaccgcagaggatgaggccctggcggtcgccatggaaggagtgaagtgagatgagtgctgcaacggcatattccaagaacaacggtttccataagtcatcgaagaccccatggggcaatccggtggtctatttcttctcgctcgtgctcgtggcgatttgcgtcgtcccggtgctctacatcatcttcggcggattccgcaccaacgcgcagatcaccaacaaccctgccggtctgccgaatccctgggtgatcagcaactacaaggaagtcatcaccagtgacatcttctggaccgagctggtcaactcactgatcgtgggcatctgcacgatggtcggcgtcgtcgtcctcggcatcatggtcagctacgtcatcgcccgctacaggttccggtactcggcactgatgtatgcgctgttctcagcgggcctcatgttcccgatgaccgtcggcatcactccgctgtacctgatgatcaggaacctgggcctgtcgaactccctcgcgggcatcatcctgccacagatcgcattcggtctgccgcagaccatcatcatcctggtcccattcctgcaatccataccgatggagttggaggaggcgtgcctgctggacggttgctctcgcctcggcttcttctggcgcatggtcatcccgctttcgatgcccggcgtcgccacgaccggcatcctcaccttcgtgggaagctggaacggctatatgcttccgctcttcgtcctgagcgatgaaagcaagtacacgcttccgcttggtgtgcagatgttcagctcccagcactcggtggatacggccagggtcctggcgttcacctcgctcgccatgcttccggccctcatctgcttcacgatcttccagaagaagatcgtgggtggcctgaccggcgcggtcaagggctgatccgacccgtcgcctgcaatgcacgaagcgcggcggcccgggcacaaccgggccgccgtttccttaaggagatcgttatgaagatcgaaaacccggtactgcccggattcaacgccgatccgtcgatgatcagggtcggagacacctactacatcgcgaattccacgttcgaatggtggcctggcgtgcgtctgcacgagtcgaaggacatggtgcattggcgcctgttgccgagcccgctgaaccgtcgttcgcagatcgacatgcgcggcaacccgtcctccggcggcgtgtgggctcccgacctgtcctatgcggacggcaagttctggctcgtgtactccgatgtcaaaatcgtcaacggcgcgttcaaggactgcacgaactacctcgtgaccgccgaggatatccgtggcccgtggagcgaaccgatccggatcaacggcgttggcttcgatgcaagcctgttccatgacgatgacgggcgcaagtacctcgtccagcagacttgggatttccgtgaatacaaccatcccttcgatggcatcacgcttaccgagttcgacgtcgagaccatgcgcctgcgccccgagaccgaacgcacgatttggcgcggcaccgatgtcaaactcgtcgaaggcccgcacctgtacaaaatcaacggcatgtactacctgttctgcgccgagggcggcaccgtctggacgcatcaggaggtcgtcgcgcgttcctcgacgctcgatgcgatgtcgttcgaggggagcccgtacgacccgttcatcagcaacttcgacaccccacgcagctacctgcagaagcaggggcatggcgcactcgtggacacgccatccggcgaatggtactacgcgtcgctgtgtgcccggccctggcaccatgagaacgaatcggtgaccgatccgcgtggatggtgcaccctgggacgtgagacgtccatccagaaagtcgaatggaccgatgacggctggcctgtcgtcgtcggcggccatggcggacaacgcgtcgtcgaggcgccgcaagacgccatcgagaccgaggcaccggccgatcacagccagcatgacgatttcgaggcgtcgcagctcgccttggattggaacacgctgcgtgtgcccttcgacgaatcgatgggttccgtcggaggcggcacgctgaccttgcgtgggcagggatcgctgtgcaacctcttcgacctgtccctcgtcgcccgccgttggcaggcgttcgatttcgacgcgtctgtcggtgtgcgattcgaccccaccaactaccggcagatggccggtctgacgaactactacaacgacctgtgctggtcgtgggctttcgtcacttgggatgagaagcggcagtgccgtgtgatcgaagtcgcccagaacgatttcaacacctacacctcgttcctgcgggaccgggcggtgccggttcccgatgatgtggagaccgtatggctgcgcacgcgtgtgcgcacgcagacctatggttacgactattcgttcgatggtgagcagtggcatgacctcggtgtcgaactggacgcgaagatcctgtcggacgactatgtgaaccaacggtatggcgggttcttcaccggtgcgttcgttgggctcgcggcagtggacctgtcgggctatgacgcaacggcggagttcgtggacttcgattaccgcgaattgagtgaatgaccatggatgcacgctgggcgggccgtctccgggacggcccgcccagcgtgcatctccatatctgcggtgcagatgacatgaccgcacggaaggcaagggacgcatatgacattgacaatgccaaagctgctggatgatggatgtgtgctgcaatccggcagacccgtgaacatctggggatggtgcacaccgggggagcgtgtctccgtacgtatcggcgaatgtgcaggggaaaccataagcgccgcggacggcggctggcaggtgcggttggacgcgttggatcctggcggcccgtatgccttcgaagtgattggcgatggcgcgacagtgcggcgctcatgctatgcgggtgaggtgttcctgtgttcggggcaatccaatatggagctttccatgcaatgggtgcatccgtactatcccagcgagttccagcggcaggatgaccccttgctgcgccagttcaaggtcgtggaccgatacgatttctccggcccggtgcgtgaccatgaggaggcctcatggctggggtgtgcacccgagacgctgggtcaattctccgcagtcgcgtatttctttgggcgaatggtgcgccagtggttgcatgtccccgtcgggctgctcaatgtatcgttgggcggttcccccatcgaagcatggatggacgccgcttcactcgatgattgtcctgaagcgttggaggagctggatccctatctgggtgatggcgtggccgaggcgcggagcgaagagagtctggctgcggtcgctgggtggatggaggaactgcaagcgcggcgaattcctgccgacaagctgcattggcgccatgtcgacctgccggcacgttttgaggattgcgggttgccgggattccagggaatgctcgaattgcggcggacagtggtgctgccgccctattgcgagggtgctgaaggcacgctgcggttgggggcatgggctgacatcgatgagacctacatcaatggaatcaacatagggggccgccccaaccaatatgagccccgtgactaccggattcctgccggtatgctgcacacgggggccaatgagattgttgtgcgccttgtctgcaacgcgggatccggccgggtgaccgaaggcaagacgatgaccttgcaggtcggcgatgaggtccatgatgtgagcggcctctggaggcttgccgtcgtggcgagcatggacaggccatgtccgagtgaggatttcgtgcgttggcgccccaccgggttgtataacgccatgctcgcgccttgcttccgtttcccggtacgcgccgcgctgtggtaccaaggggaatcgaacaccgggaccagggcggcgcaatacggaaaactgctcgccacgatgatcgatttgtggcgggagcgttggcatgatccgcatatgcccttcctcatcgtgcaattgcccggcatcagcatcgattgcatcgaggacggcggttggccgctcgtacgcgtcgggcagtgggccgtcgggcagcaagtgcccgacgtgaagacggtcgtgacgctggatgccggtgaacccaacgacttgcatccgcatgacaagaagctcgtcgcgtcacgtctgttcgacgcggcatgtgcgctgctctatggaggcgacaatgtgcagccgatggtggagaggatcgaggaacgcgatgggatgctgtgtgtctcctatgccactgttgcccgccaaggggccaatccggtcccttgcacgccgttgacgctcgatggcggcgatccgggcgaattcgagttcgtctggcgcgatgccatgtgcgcggtgcctgcacctgcgacggttgagggggcagaagtgtgcattccgctgcctgagcggcgtcccgacatactgcggtatgcatggcggaacaacccgtcacgcggtctgcttgtggatggccgtggcactccgatgcctccatttgcctatgatttgaagcgtggtgccatgatcgagccatcggtgcgcgctggcggagacgtcgatgccgggacgggacgtgcgtgatgcgcaggcaagtcacatgtgagcagggaacactcgagggattggcggtgggtgatccctccatcacagcttttcgtggggtgccgttcgccgctccaccagtggggccgctgcgttggcgaccaccccagtcgccggcgccttggcaaggtgtacggtgcgcgttcgacgatgccccggcctgcctgcaacccattccgggagcgtcaaacccgttctatgacaaggaatggggcatggatcccgccatcccgctcgatgaggattgcctgtatctgaacatctggacgccggcattgcgggggagcggcgccgatgcgcgcctcaccggcgaatccctgccggtcatggtgtggatccatggaggcgcctaccagtgcggttgcgcgatggagaaggagttcgacggcaccgcgctcgcgcgtcagggcgttgtggttgtgtcggtggcatatcggctgaacgtgttcggatttttctcacaccgctggctgcaggagaaagcggaggaaggcgccccgtatgcgaatttcggatggttggaccaacaggccgcccttcggtgggtgcgccgcaacatcaccgttttcggtggcgaccccacgcgcatatgcgtcttcgggcaatccgcgggtgcggcttcggtattggcgcaatgctgcgcgccgagtaatgccggactgttctcccgggccatcatgcaatcaggcgcgggccttggctacttcaatgcaacgctgtgctcattggaatccgcacagtcgacgggcgcaaggttgatgcggcgtctgggggtggagaacctcgatgaggcacgggatgtcgatgcgcagaccctgttcgagggagcatctaggcttgaggcgcctgaaggtgtggatgatgccgcatggccgatgatggtcaattgggtgccatgtgtcgatggcgtcttcatgccacggcaggagcgcgatctgatacttgacggccaaaccaagaacatcgatctggtggtgggtgatacgcaagacgaattcatggtgtccgacgggcaaggccatcaggtgcgggctggccgcgaaggcaaccgccggctgatcgcagcatggcagcatggtggcggccgcgcaccgtattattaccatttcgatgtgccgatgcccggcgatgacgcgggctccttccattcttccgacctctggttcgtgttcgggaccttgggctcatgctggcgacccatgcgtggatgccatgttgagctctcccaatgcatgtcacggtattggacgcgttttgcggcgatgggcgatcccagtggaccgggtcttgtgcactgggaccgcaccgacatgcatggcgaccgcttcctgcatctgggtttccctgtggaaatgcgcagtgggcatcgcggcgcatgactacaccttgggtcaagctcccatatccgaggcatcgtgataacggaagcgcatgaagtcggcatgtcctctaacatgctgggtcgcttgggtgaacagtgcgaaccggcatcctgtgaaatgatccagtttgaaccacaggcggtggggatgtccgatcggtatccacccggcgtctgtccgcacaaggaaacgcgcggtatcgcgcatgtcggtgtagtcgatctccaaacggaacgtgacctgcggtgacggcaatggcagggactccacttcaaccgggatctcgtcgtaatggcgctcggcggtgttgtccgggtgcaacgcattgcgttccgccatgatcgcatgccaagatccctgcctgcgtgttatggcggcgtatgcgtagcagccttggaatgcgcagagcccggcgatgtcgccttccatgagtccgctggcgtcaatggtcacttccgcggcgcaccgtgggccggtcgtgcgttgcgtaagcgtattggtcgcccgcagcatggtggccgatacgcggcttgtggtgatgcggaatgcgccggggcgcgcggtcaccgaccatgtctcgtcatgtggtgtgtggttgaactgccaatagggggccagatggatggttcccctgctatcgggcgtgtagcggaaatcgtcatcgccgttgagcggcgcataatgatggtgcggttcggcggaaggcgcgctttcgacgtatgccggaactcgcccgttcacgcccaatacgggcatgccgtccgtatcgaaatgcatcggcatgagcacgggtgtcctgcccaatgccccgcggtcctggaacatgaacgcgtaccattggccatcgggcgtgtccaccatgccaccttgcgccacaccttggtcatggtatcccaagtcgtcatccagaatgcagcggccccggaactcaccgtcaagcgaatccgcgatgaaacaatcctcggttttgcggtggccacgggcgaaatgacaggtgaacaggtaataccgcccatcatgccgttgcagatgggatccctcgtatcccagatcctgattcggcaaatcctgcacgagcacacggtcgagtccaccggccttcggtccggacagatccgcatccatctcggtcagccgcagtgcggtgttgccgtgaacgatgaacacacgcccatcgtcaaagagcagcgaaggatcgtggtagaagccccggacgatatgatgccgccatgggccgcgggcgtccctggcggtgaacagatgggttgtatgggtgtcgttcgcggagaacagcacatggaacctgccgttgtgccatcgcagggacggcgcccacattccctgcccatacaggtcctgatcgtcgtccagcatataggcgcccgtgtgcccaagtgtgcggtagacatggccatatggttcccagtgcgtcaggtcgaacgacctcaatatgtcgcatccgggcatgaaatgcatcgtggtgctcgccatgtaataggtatggccgaccctgatgatgtcgggatcgggaaagtccgagttgagtattggattctggacgacgctcatgaaactccctggaatcggaatcgacaatatggaatgccgggtggtgggcacaatgtgcgcatggtgcacaccacccggcctgggtggaatcagccgcgagcctgcacgtaggcgtcgtagacctgcggggtgggggtgccggtctgcaccgcatcaatcgagatcggccaatcgggcgcgtcatccacgccgctgagcacccaagccgcctgtcgtgcggctccgatggccacgtattcgtcggtggcggggcaggtgatctccatgccgagcacagttggggccaacgtgcgcaccgcacgcgatttcgctccgccgccgatgagtaggatgcgctcaatcgcggcgccgagcgagcggatgagctccagacagtctcgttgtgagcacagcaacccctcgacgaatgcgcgggcgaagttcgcgcgattggtgttgcgtagcgtcatcccgctgagagtggcagtggcgtccggtcggttcggtgtgcgttcgccgtcgaaatacggcaccaatgtgatgccgccggcaccggggcgcgcggccagggcgaggtcggtgagctcctcgtagtccacgtcgagcaccgcacgtcctgcatcgagaatgcgggaggcgttgatggtgcaggccaggggcaggaaatgcccggtgcaatccgcgaatccggaaacagagccgttcagatcgtatgcagggcgctcgctcacagccgcagcgacacccgatgtgccaagggacaccgacacatctccgacggccattcccaagcccagggctgccattgcattgtcgcccccacccggggcgatgatgcagcccccgtctaccgcgcctccggcaatcgatggggaggccttcaccttggcggcctcttgtgggcccagcacggcgggcagcacaatgcgtgcggcggcctgtaggcattcgggtgccggttcgtccgctgcggccgattgcaagccccgggcgagcagatcgcgccggtaggtgttggacgccgcgtcgaaatacaaggtgccggaggcgtcggaacggtcggtgaacagtgcatccaaatgggcatcctcgccaggatccactggtccgaaaccggctatgcgccagctcagccagtcgtgagggaggcagacggccgctatgcgcgccgcatgttgcggctcgtgctcgctcacccagcgcagcttcgtcagcgtgtatgaggcgacgggggaggagcccaccgcgcgaacccagcgggagatgccgcgggcgtggcgatcctccggttcgccgtcggccgccggtgccgcaccgagttcatcgatgagttcaacggcttgaggggccgacgagatgtcgttccacagcatcgcatcgcggatcacgcgcccttgctcgtcgaggatcaccatgccatgttgttggccgccgacggcaattgccgagacgtcgtccaatccgccggcctgctcactggcttcgaggaacgcctcccaccaggcctggggatccactgtcgatccgtccgggtgcttcgcctggccgaagcgtacgagcttacctgtccgggcatcggtgacgcgcaccttgcatgattgggtcgaagtgtcgacgcccgcaaccaacatcggttccatattgtctccttgctctggcttccacagacgttccgtggtcgcgtgtgttccggttcctacgcggatcgcagacgacagccctgccgtatgcgacccaatatagtatgttcattaaactaataagtctagtgtagcatggcttgttaggcaagtgggttaactattggctcgaagatgggggtcgacatggcgacgctgaaacgaatcaatcaagatgatctacgcaatcacaatctctcggtggttctgaatcaggtgctgcgctcgccgcaaccgctcagccgggccgatctggcaaaggcgacgggattgaccaaggcgacgatgtctctgttggtctcgctcctcattgagcatggtgtgctcagggaaggggtgccgcttgtgcaggcggtatacggcaggccgagcacgccgctgatcatcgccggcggccgggtgtgcggcatcggcatccagatcaacaccgacggctacggctatacggtgctcgaccttgacggctcgacggtggccgagcggtgggtggaccgcgatctgcacgaggtggatgcggacgagatattcgccgatctcgacgccatgctgctcgatcaggaacagaccttgcgcgagcagggctacattcttgccggaaccggaatcgcgctacccggattggtcaccgaagatgcgcacctgattgtcgcgcgcaacctcggttgggagaacatagacctcatgcagtacgacgtgatcaagcgactcaatgtggttgccggaaatgagtcgaacatggctgcaaccgcgcatcttcccggctatgccacgcaggtccatgacgagggcatggtggggccggacggctcgttcatctacgtttccaccgacatcggcatcggcggagccattgtgcgcgacggcaaggtggtggacggcggacatggattcgccggtgagatcgggcatctttccgtgcagctggatggcccgcagtgccgttgcggacggcatggatgcctcgaggtctacgcaggccgccgctcgatggtggagcgcgccgggcttgccagcggcgatgccgccgcaagccaacaggccatagatatgttcacgcaggctgttttcgacggtgcggaacccatgcacaacgtctatttgaaagccttcggcgcaatggtctcggcaatcgtctcgaccatcaatctgtcggacgtggacacggtgatcatcggaggctgctgggcgcagctctccgccgaagagcgcgaacgcatgcaggccgaggtgcagcgccagatcctcgcgcgcgacaaggtcgaggcgcatattctgcttacgcgggacatgcggaggccggcgctcatcggcgccgcgcagatcggccttcgcaagttcgtggacaatccgctggcgtatctcacggcggattccgtggcgtagtgacccaagcgggatgcgtcgcgcgccgtcgtacgtcgagcgggtgggctacgcttttgctgtccggttcacgcttcgccagcggggtggggcgacccgggtcccccgtatctttaggagacgatgttatgcagcagggtattcatcctgattatcacaaggtgaccgtcacgtgttcgtgcggtaacacgttcgagacgcgttcgaccgccaagggcgaccatatgacggtggatgtgtgctcgaagtgccatccgttctacaccggcaagcagaagattctcgacaccggcggccgtgtggcccgcttcgagaagcgctacggcaagaagagcgcctgatacgcttcgacgccagccctgttgggctggcgtttttgtttggcatgcgcccgtgcagccgggcataccgtttcgtccgcacgccacgtgtgtggaatctgtgaacaatgcccactatgtataggcggcccacgagcggaccacccgactgagtacacttcaatctgttcgaagcatttgtgtaggcaagagtcaagtaaggcgaagattggcaagcgaagagtttcccgcggcgaagaccgcgttggaggaatacgagaacatcgaacgccagatgggcgagcaggaggtctggtcgaaccccgacaagatgcgcaagctcggtcgcaggcaagcgcagctcggcaccatagtcaacgcataccgcacatggctcaacatcaggaacgacctcgacgcggcccaggagatggccggagaggatccggatttcgcacaggaagccaagcgtctggagtccgagctgcctgaggcggaggagaagctgcgtacggcgctcattcctcgtgacccggacgacgcgcgcgatgtgatcatggagatcaaagccggcgcgggcggcgaggaggcggcgttgttcgccggcgatctgctgcgcatgtacatgcggtacgcggagaagcgcggctggggtgtgaccatccaaagcgagaactccaccgagctcggcggcgtgaaagacgtgcagatggccatccgcgccaagggaaacccgtctccggaagaaggggtgtgggcatcgctcaaatacgagggcggtgtgcatcgcgtgcagcgcatcccggtcaccgagtcgcagggacgcatccagacctccgccgcaggcgtcatcgtgttcccggaggccgacgaagacgacgatgagatcgagatcgacccgaaagatctgaagatcgacattttcatgagctccggtccgggcggccagtccgtcaacacgacgtattcggcagtgcgtatgacgcacattcccaccggcatcgttgtgagcatgcaggacgagaaatcgcagattcagaaccgcgccgccgcactgcgcgtgctcaagagccgtctgctcgcgatgaagcacgaacaggaggccgccgaagccgccgacatgcgccattcgcaggtgcgttcgctcgaccgttcggaaagaatccgcacctacaacttcccggagaatcgcattgtggatcaccgcacgaactacaaggcgtacaatctggacgccgtgctcgacggcgatctgcaggcggtgatcgacagcgacatccaggctgacgaggagcagcggctcgcaagtcagcagcaacagcaataggcatgcctgccgactttggcatgtatcccaactgcattcacacattacggaaaagcccagatgaccacagaccaactcattcaccgttgcgccgaatacctgcgcgaagccggagtcgacacccccgagcatgacgtcaagctgatcatggcggatgtgctcggatgctcgccctccgatgtcgaatcggccgcaatcatgcgcaccgacgtgcgtgcgctgtgtgcgaagtacggcagggacgacgacgcggagctcgtgcacacgttcaagcacatggtgtgccggcgtcatgcacgcgaaccgttgcagtacatcgtgggccatgcgccgttccgctatctcgacctcaaggtggggcccggggtgttcattccgcggcaggagaccgaactgatcgcacaggacgccatcgagtgggtgacacggcatggaatctattcgccacgaatcgtggacttgtgcgcgggcagcggtgcgttgggactggcattggccaccgagattccgggagcccaggtgtggggcgtggaactgagcccgcaggccgcggtgtggacgcgccgcaatatcacgcagatctcacgcacataccccgatatcaccgcgaactaccacttggagatcgccgatgccacctgcccgatcacgctcgcgcatctcgacggtacggtcgacgtcgtggtgagcaacccgccgtacgtgccgcagtcgcaggtgccgcagcagccggaagtgcgtgatttcgacccgtcgctcgcgttgtacgggggatcgtctgatggcatgctcattcccgagcagatcattcggcgtgcctatgcgctgcttcgcccgggtggcctgttcctcatggagcacgacatctcgcagcccgaccgcacagtggccttcgcgcgcgccagcggattcagtgacgcccgcacgggggccgatctcacttaccggccgcgctatctggtggcgaccaagtaggagacatcctttcccgtagaaccatgaacatagcggcatcacagcgaatacacagctccggcgcgtacaatacggcaggtcggagcggacacagctggcaacatgccagataggcaggaggcaaggcacatggcagacgtgcgcagtgcagacgaacagacgctggccgacgcaaggcgaatcatagccgatggcggtctggtggtcattcccacagacaccgtatacggcatcgcctgcgacccgtgcaacgccgcggccatagcgcgcatctacgccgccaagcatcggccggctgacaaggcgttgcaggtcattatgccggacctctcggtgctgcccaagctcggtcttgcgcttcccacgccgctcgatgcattggctcgccgtttcctgcccggcgcgttctcgccgattgccgtggctgatgacgattcgccgctgctcacggtgcgtgtcgacgattccggcgcgcgtacccaaggcattcgagtccccgattccgaggtgaccttgcgtgtgctgcgtgcaatcggcccggttgcggcgtcgagtgcgaaccgctccggcaacgaaagcgcgcagaccgtcgatgaggctgttgcggcgttgggtgattcggttgacctgtacatcgatggcggcccgaccgtgagccatacggcaagcaccgtggtggccgccgatcccgatgctccggatgggattgtgatccttcgcgaggggcgattggaagccgacgcagtcagacgggcggtgcgtgaggaagcgcggcatgggggtacggccggtcaatgagggcctacatattcattgccatggtggccatggtggccacgtacctgtacacgccgctcatccgtcacctcgccattcagctcggtgcggtgggcgaggtgcgtgcccgtgacgtgcacaccgtgccaacgccacgcatgggcggcgtggccatgctgctcggtttcatcaccgccatgttcttcgcctccaggctcaacttcctgcaaggcgaattccgccagaaccaccaggcctgggtggtgatggcaggcgccgctatgatctgcctgctcggcgtggccgacgatgtgtgggatctcgattggatgctcaaactcgccggccagctgctcatctcggtattcgtggcatggggaggtctgcagatcatctcgctgcctatcggcggcctgctcaccgcgtccccgatgatctccatagcgatcacggccttgctgattgtggtctcaatcaatgcggtgaacttcgtggacggactcgatggcttggccgcaggcatcgtggcgatcggcggcatcgcattcggcatatactcctatgtgctgtcacgccagcaggtttcgtatgcatcaatggcgacgctcgtcgacgtggcgatggtgggcatctgccttggcttcctgctgcacaactggcacccggcgaaactgttcatgggggactccggttcgatgctgctcggctacctcatcacctgcgcgtcgatcatcatcaccgggcgtctcgatccggcgacgatcaacacctcggcctacgtgccggcattcatgccgatactgctgcccgtgctcgtgctgttcctgccggtgctcgacatgctcatggcaatcacacgacgcctgcgcaaggggcagtcacccatgcatcccgatcgcatgcatctgcatcaccgcatgctccgcataggccatactgtgcagggggccgtgcttattctgtggggctgggccgcgttgatcgcgttctcttcgatgttcctgctgttcttcagattcgtggatgtgctcatcgggttcgtcgtgctggcggtgctactcaccatcgccacgctgtacccgtatttcaagcgcatgggtcccggtgctcacagcaatgacggcgtactgccgaaaagcaatgcacccaagcacgtccaggagtccggacgggcataaccgccagcttcgatcttcgtgcaaatccccgcaatttctcttcccccccctttgcctccccgcttgctgtttcccctgcgcttcccctgcgtaatttgggtcatctggatgcccgattctgtctctttttacgcagattggcagattggcagattggctgcgtaatcggggacaggtggagggcgtcttccgcctctttgcaggcggaagacgacgcgaaagacatgcggattcatagagcggacgtgtgttttggcgttggtcggcgtggctccatatagtgttgctatggctacaattcctaatgcagaatccccatacacccccctccccccaatcttcgcccagctgggcctcgcctatgacgatgtgctgctgttgccgaacgaaaccgacgtgattccgtcggaagtggacacctccacccatctgacccgcaacatcacgatgaaggtgccggtgctgtccgctgcaatggacacggtgaccgaggccgacatggccatcgcgatggcacgcaacggcggcatcggcgtgctgcaccgcaatctctccatcgacgaccaggccgcccaggtggatgtggtcaagcgcagcgaatccggcatgatcaccgatccgttgacggtgaatcccgacgccacgctcgccgacctcgacaaactgtgcggcaagttccacatctccggtctgccggtggtggaccacgacaacaagctcgtcggcatcatcacgaaccgcgacatgcgcttcatcgcctccgaggactacgaccatctgcgcgtcaaggacgtgatgacgaaggagaacctcgtcaccggtccgtccgacatctcgaagaaggacgcgcacgacctgctcgcgaagaacaagatcgaaaagctgccgctcgtcgacggcgaaggccacctgaccggtctgatcacggtgaaggacttcgtgaagaccgaacagtacccggatgccacgaaggacggccagggacgcctgcgcgtcgccgccggcatcggctacctcggcgacgcatggcagcgtgcctccgcgctcatggaggccggcgtcgatgtgctcgtggtcgacaccgccaacggcgaggcgaagatcgcgctcgacatgatccgtcgtatcaagaacgattccgcattcaatggcgttgacatcattggcggcaacatcgccacccgacagggtgcccaggcgatgatcgacgcgggtgtcgacgccgtcaaagtgggtgtgggccctggctcaatctgcacgacgcgtgtggtggcgggcgtgggcgttccgcagctcaccgcggtgtatgaggcggcgcaggcatgtcgcgccgcaggcgtgccgtgcatcgccgacggcggcatccactactcgggcgacatcgccaaggcgctcgtcgccggcgccagctccgtcatgcttggcggcgtgcttgccggcaccgaggaggcccctggcgaaaaggtgctgctgcatggcaagcagtacaagctctaccgtggcatgggttcaatgggagccatggcaccgcgaggtaagaagtcgtattccaaggatcgttacttccagtcggacgtcacgagcaccgacaagatcgtgccggagggtgtcgaaggcgaagtgccgtaccgcggtccgctgggcgccgtgctgtaccagatgatcggcggcctgcaccagtccatgttctacatcggtgcccacaacatcgccgagatgagcgagaagggccgcttcattcgcatcaccgacgccggcctgcgtgaatcgcatccgcacgacatcgtgatgaccgccgaggcgccgaactactccggccgctgagcacatatccaacacggtggctcttaggagccgtatgcagccataagcgccgtgacgcagatacaatctgtgtcacggcgcttttccatgccgggcacctgcggcgactacgctatgagaaacaccgcatatgggtgaggcgtctacaatatgagcacgaatggtccatgaaggaaccggcaggaaagaggaacatggtagacgcaaacgacgcgctgacgtattcgcctgagacatcgcgcatgatctggatcgactgcgagatgaccggactcgacatcttccacgatgaactgtgcgaggtctccgtggtgcccacggatttcgagctcaatgtgctcgacaaaggaatcgatttggtgatcaagccgtcggaggccgctgtcgcccatatggacgatttcgtgcgtgcgatgcacacccgttccggcctcatcgacgagtgggagaacggcttgtcggtgcaggaagccgagcgtcaggtgatcgactatgtgcaacaattcattccgcagggcgtcaaaccattgctcgccggcaattcggtcggttccgacaagaagttcctcgaccgcttcatgccgaatctcatggagcacctgcattaccgcgtgatcgacgtgagcacgatcaaggaactcgcgcgccgctggtacccggcggtctacgagaaccggccgccgaagaacggcggccaccgcgcatgggccgacatcgtcgagtcgcttgacgagttgcggtactaccgcgcagccatcatggcgcccgaacccggtcccgacaccgtgcagtccaagcgcatcgccgagcagatcgtcgcgacgagcgtgatgaatgaggccgaataaccatctgcagtatcgcggagccggtcatgcaccgctatacggcaacgccgcgcaataacaaaggagcgcatatggcagaagttgaatggacggaaatcaaggaaccacaggacatcaagctcgtcgtggcagacatggacgcgacgctgctggacgccgacgggcagattcccgcggggttctggccgatgctcgacaggctcaaccagaaaggcgtcaccttcgtgccggcgagcggtcggcagtaccagacgctgcagcagatgttctcgcgcagtgtcaggccgatgtcgttcatcgccgagaacggcaacatcgtctcgctggacggtaatgtgatcgaaacgcatacggtgagccgtgatctggtcaagcaggtcatcgacatctgcgacaaggccgccgagacgggcgaatacaacatcggactcgtggtgtgtggtctcaatgccgcgtatattcagcgcaccgacgaggagttcatcgccgaggtgagcaaatactacgcgaaggtcgagccggtgaacaatcttcgtgaagtgctcgactacgtcgacgagaaattcctcaagctcgccatcttcgatttcgaaccggccgagccgatggccaaggatctgctcgccggcatcgagcagccttacgaatacgtgctctcgggcaagcattgggcggacatcatggattcgcgcgtctccaagggagacggcgtggtcgtattgcagaaggcgcttggcgtgggtgtcgacgagaccgccgtgttcggcgactatctcaacgacgtgccgatgttcgaacacgcgcgctattcgttcgccgtggccaacgcccacccgcaggtgcgcgcggccgccgcctacatcgcgccggcgaacactgaggagggcgtgatccgcgtcgtcgaccgcatcgtcaggtgacagctgtacagcgtagcgtcacggccctattgtagagagcatgaagcagagcgaagcccttgagattatgcttgccggcgccagcgcgttcctcaccggagcgcccggagccggcaagacgtatgtgctcaaccggtttgtgcaggccaaacgcgaacagggctccacggtcgcggtgacggccacgaccggcattgccgcgacgcatgtagacggccagacgattcacgcatggagcggcataggggtggccgattcgctcaccgactcgctcatcaagacgatccgcacacgccggcgcaagcagatcaaatcgactgacgtgctcgtgatcgacgagatctcgatgatgcacgcgtggctgttcgacatggtcgacgaggtctgccgcatcatacgcaaggattcgcgccccttcggcggcctgcaggtggtgctctccggcgatttcttccagttgccgccagtgggtgcctcgcggcgcaacacggccatgacgcccacgcccgagtatgtgtcgatgcgtgagcggtatgcgcaggcgggaaagaacccggagggattcgtcactgaatcctttgcttgggacgcgctcgacccggtgatctgctatctcgatgagcagcatcgtcaggacgacgggcagctgctgcgtgtgctcaccgatattcgtggcgacatggtctcgcagatcgacaaagacattctcatcacccgctaccaggtgccacttgaagaggggaagcaggccgtgtccctgttcccgcagaaccggcaggccgatcttgtgaacgaacgccagcttgcgcagattgacggcgacgagcatgagttcttcgccgaggcgcgcgggcaggcgaatctgatcgaacggctcaagaggaacatgctcgctcccgagcacctcgtgctcaagaagaacgccgtggtgatggccgtgcgcaacgatgccgagggccgctatgtgaacggctcgctgggcatggtgattggattcctcaaggatgcgcgcggcggttggcccatcgtcgaattcgagaacggcaacgtggtgaccatgaagcgcgccgattgggagatgatggatggcgatgacgtgctcgcgtcggtgtcgcaggtgccgctgcggtgcgcctgggcgattacgatacacaaatcgcagggcatgacgctcgattcggccatcatggatctgtcgcgcaccttcgcaccgggcatgggttatgtggcgctctctcgcgtggagaagctcgacgggctgtacctcaacggcgtgcataaccgcatgttcaatgtgagcgcagacgccgttctgctcgacgatgcgttgcgtgccggatcggcccgtgcggccgcgcagctcgcggagcagggggcggattcgttctcacatcgttccccggaccatgccgtactcggcgcgacgggtgaatccggcgcagcggaatccacgcagaccttgttcgacgcgctcgacgaattcggtggcacgggcgaaccggcgttctgaattgctgcacagataccgtcggctcgctttcgtcacgcccgatgagccgcacgattagaatggaacagtatttcgtactgacagaggaaagaggaaatccatgaaacactcggcaatgtacatcatctcaggaatcggcgcgctcgtgctgttcgtggcgttcctgttctacacctctgcaccggtgaatctggtgggctggttcaaactctccgatctgctcacgatcattggcggactcatgttcatcattccgttctacattgtctccgtgcggcgcaaaatgcgcgacaacgcgccgaatccgtgggcgtggcagtatctgccggtgatcggcatggtgctcatggtgatcggcttgatcttcccgaatggcaagctcaccgtcggtgtgatcgacctgtgcgacgtgctgtacctgttcggttgcgtgttcatgctgatgatcttcgtctacccgttcggctcggtgaacgaggagatgcttgagagcgacgtggacgaacgcgttgacgacgacgcgcgccaataggctcgcagaccgttccgatatccgggcgcaccgctggcattcgctggcggggcgcccgcttgcatacaccggcgatgtcgtggaatacgcataatttgaagggtatgaccaaagctcttcgaatgtccacactgttcctgcgcacgctgcgtgaagaccccgcagacgcagacgtcgattccgcaaagctgctccagcgagccggttatattcgcaaggccgccccgggcatatggacgtggctgccgctcggcctcgccgttctcaacaagatcgaagacgtcattcgcgaggagatcaacggcattggcgcgcaggaagtgcacttcccggccctgctgccgcgcgagccgtacgaggcgacccaccgttgggaggagtacggcgacaacatcttccgcctgaaggatcgccatgaggcggattacctgcttgcaccgacgcatgaggaaatgttcacgctgctcgtcaaagacatgtactcgtcgtacaaggacctgccggtgacgctctaccagatccagacgaagtaccgcgacgagttccgcccccgcgcgggtctgattcgcggccgcgagttcattatgaaggatgcctactcgttcacagtggacgaggagggcatgcgccaggcgtacatggatgagcgcggtgcgtatgagcgcatcttccagcgtctcgacttgaagtatgtgccggtgttcgcgatgtcgggcccgatgggcggctccgcttccgaggagttcctggcgccgatgccgattggtgaggatacgttcgccctggccccttccggcaaggcctggaacgtggaggctctgcacacgccggctgtcgaggccgtggattgttcgcagaccccggatgccaccaagcgggccacgccgaacgcgcgcacgatcgacgagatgatcgcgttcgcgaatgccgaatacccgcgcgaggatggccgtgactggcaggcctcagacattctcaagaacgtcgtcatcgccgtcaagcatgccgaggacgacgagcatgacgaaccatggcgcgaactggtggttgtgggcatcccgggagatcgtacgatcgacatgaagcgcttggaggcgcagttcgccccggccgagctcgaggaggccaccgaggacgacctcaaggcgcatccggagctggtacgcggctacatcgggcctatgggcttcggcccgcaggcgcggggtgacgacgggacggccgagacgttgcggtacctgattgacgcgcatgtggctgaaggctctgcatggttcaccggcgccgacgaggagggcgtggattactacgacctcgtctatggtcgcgatttcaaggccgacgacgtggtggaagccgttcaggtgcgcgacggcgacatgagcccggatggttcaggcccgctcagcttcgagcgtggtgtggagattggtcaggtgttccagctcggtctcaagtattctgaggcgctcgacctcaaggtgctcaaccagaatggcaagacagtgccggtgtggatgggctgctatggcattggcgtgagccgtgtgcttgcctgcatcgccgagacgcaccatgacgacaagggtctggcgtggccgatgaacatcgcccccgcccaggtgcatgtgatggccaccggcaaggacgaagcggcattcgaagccgccgagaggctggtcgatgaactttcggccaatggcatcgaggtgctctacgacgaccgcagaaaggtctcgccgggcgtcaagttcaaggacgccgaactcatcggtgtgccgatcatcgccgtcgccggccgtgatacggtgaacaacggcacgatcgaggttcgtgatcgtgacggttccaacagtgagaacatcagcgtcgattcagtggcgcaggtgatcgtcgaccgcgtgcatgaggcattgaagtaggtcaaggcgaaatatgtggcagtgggctccgggaaaccggggcccattcatttcctgccatggccacccgagttatgcacatgcctgtggacgggtgtggataatgggtcggtcatccaccgttgtaccaacacgccgtcctccgaccacaatgccctgttcggcttggcacgccgggtctcttgcctgaagatggaaccaagaacacatcgcacggaaagaggcttacatggcattacaacaaggagcggtcacgatcacggggtatcttggcgcagatccccaacagtatggcaggaatccgagtcgccctgcatgcacgttccgactgggatccacacgccggtatcaggatcgtaatggcgtatggcagcaactgccgaccacatggctcaccgtcaaagcctttcgtggcctagcggccaacatcatgcaatcgctgcatagaggcgacccggccatagtcaccggattgctcaacaccgagcaatggcgcgacgagcagggtgtggatcattcacgtctggtgctcgaggcgagcaacgtcggtttggacctgaactacgtggtcacgatgtcgatgcgcacgccgcgggaagggtacaccggacagcaggctccctcacagatggcatctgacgagcagggttcccccatgcgtccacagacccagcaggctacgtcggcagctcctcaatcaaccctgtcacgctcctctatggcaccgggcgatgacggcggcaatcccgtggatcccttcaaccagatgccgccggattgcctgtctcccgatgccgctgcgagcatgccacagcaaggggatcaacgggatgcggccctggagccattggtaggcaacgggatgccgccgcaggatttggaacacggttgcgcaaccgacacgacgaactcgcgaaaggaggtgaggcctgaggatcaagacgaattctaatcgctgcacttgttttcatatggttgtggggccctacgggccccacaaccatatgtggccaatatgctcattggcaagcctgccagagactaccagatgcgcacgcgttcctctggtttgagccacatgcggtcgttgtcggtgacgccgaaggccttgtagaacagattcacgttgcgcgcgatgccgttcgtacggtcctcggcgggggagtgcgggtcgatctgcaggtactgctctgcgagctcatcgcgcatcttcgttcgccagatctgtgcgtacccgaggaagaagcgctgcaatccgctgaatccatcgatctcaggggacatctccaatgctccttcgatgccggacggcgaggcgtcgacaggcagcccgtgctgctcgtccagcgcgaaggcataggccttcaacgcgatgttgacgccactgagatcgcctatgttctcgccaatcgtaagcgagccgttgacatgtggcatcttgtcgggctcgtcggcgtacttctcacgcagttgcaccggcacgaactcgtcgtactggtcgataagcgcttgtgtgagctgcttgaaatgcttgcggtcctcgtcggtccaccaatcctcgagtttgccgctgccgttgaactgggagccctggtcatcgaacccgtggccgatctcatggccgattacggtgccgatgccgccgtagttcacggcgtcctcggcctgcggattgaagaacgggggttgcagaatggcggctgggaacacgatgatattacgggtgggctcgtagtacgcgttcaccgtctgcgggttcatgagccattcgcccttgttcacaggcttgccgctcttcgaaacctgatagccgaactcgtagacggccgccgccctcatgttgtccatgagcggggcatcggcatgcacgtcgagcgccgtgtagtcgcgccaatcgtcggggtagccgatgtacggctcgaaggagttgagcttgtcaatcgccttgcgcttggtctcctcgcctagccagtcgctgttcacaatcgagatgtggtaggcctgaatgaggttgctcaccagttcctgcatgcgcttcttcgacgattccgggaaatgcagcttcacatagaccttgccgacatcttcgccgcatatgccattgacgagcgagacgccgcgcttccaccgatcacgctgctgcttcgtgccagaaagaacctgcccgtagaacgagaagttcgtcttgtcgaacacggagctcagcatgctcgcgttgtcgatgatcacatgcacgcgcgcccacagcttcaggtcgtcgaggctcgctgcagcccagaatccgtcaaggccggtgacgaagctcggctcgtccacaatgatgttcgcgaaggctccgagcatgtcaaccggcatcgtgcgggcggcatgcgaggtgtcgtagctttcctgcacggccttgatccaacgctcaatgtcgaaatggatgaacatggccttgagctcgtcaaaagtggtggggttgttcgtcgcctgcgggtccctcgtcttcacattgtcccaatggtgcgaggcgatgcgagtctcgacgtcgaggaaccgttcggcgagatcctgggccttctcctcgtcgtcggcgtagccggcgttgcgcagctgcttcgcgaccatcgacacatactcctgacggatctgctcatggtggtcttcgcggtagtatgcttcgtcgggcagtccgatgcccccctggccgaggtagagcacattcgtctcagggtggttcatgtcgccgaacacgctgaagccgaagaggtccggaccgccgaacgggctcagccgcccgagcacatcgatgagcccctctttcgtccgtgcttcgtcaatggcaatgagatcggcgcgaatcggctcgattccagctgcttcaatcgcgtcggtgtcgaggaacgcatggtacagcgccttcgatttcgacgcctcctcggaatccgtttcgagaatgtcgcgaatctgctcctcggcgttttccgacagtcgattgaaggaaccgtagctggagcggtcatcgggaaggcggtacgtgtcgatccacggaccgttcacatagcggaagagatcgtccttgggtgagatcacggcggagaacgaggccggatcgatgcctgattgcaaagtggtatccataacttcacactatagatgtttcccgacagcgcggcgctgggtcacggtgtagaatctggcacccgtacaagctgaatggacatatttctcgtccgaagtcaactacgctcgttggagaatacacgggcgaaactgtgcaaacagaccgcggatagataacactgtaagtaaacatatccgcgaatgcagtcgccatgccggaaagcatccggagcgccggtgcgttcagagaatctgaaggaggagatatgtcggaaccgaatccgcaatatcaaaaccagcaatacaaccaaagcccattccgactgttcgagggaatgctgccgaccggcgcgaagaacctcgtgcgcggcacatacggcgtcatcggcgtcgccgcgctcgcattgggcatctgcctgctcgtgtggccgggcatcacgctcaaggtggccgccatcgtgcttggcatctacttcctcatttcgggcgtcgtgcgcatcgtcagctcgctcgttgaaatgggactgcccgccggctggaggatcctcggcgtgctcatcggcatcatcctcgtgatcggcggcatcgtcatcttcaagaacgtcacgatgtccaccgccatgctcgccatcatgttcacgctcatcgtgggcatctgctggatcatggagggcgtgatggcacttgccgaatcgtggagcgtgccgagctcgggctgggcgatcgcctacgcgatcatctcgatcatcgccggcttcgtgctgctgtgcatgccgatggcgtccacgctgtggctgatcatcttcggcggctgcgccatggtggtcatgggcatctgcgcgattgtgcgtgccttcaccttcggccgcgtgaagaagaacaactgaaactccttatgaatatatgcgaaacccggtgccatatgcgccgggtttcgcatatctgcgcgaatatgcgcggcgtctcccattacaatgtaaggcgtgcagattagtctgaaaacggtttggcaaaagcttgctggaaaagagaacacgatgatcgaattgaagacaccccaggagatcgaggaaatgaagccggccggccatttcgtcggcagcattctcaacgagctgcgtgagaagaccaaggtgggcacgaatctgctggagatcgatgagattgtgcacaagcgcattgccgacaggaagggcgcgcaatcctgctacgtcgactacgcgccggacttcggcacgggaccgttcgcccattacatctgcatttcgatcaacgatgcggtgctgcacggtgtgccgtatgactacacgctcaaggacggcgatctggtcagcctcgacctcgccatcagcgtcgacggctgggtgggtgactcggccatcagcttcgtggttggcaaagacaaggatccaagtgacctgcgtctcatcaagtccaccgaggaggcgctcgccgcgggcatcgccgaagccattcccggcaaccgtctgggtgatatctcccacgcgatcggcgaagtggcggcggaatacggctacccggtgaacctcgaattcggcggccatggcgtcggccacatcatgcacggcgacccgcatgtgcccaacgacggcaaggcacaccacggctacaagctgcgtccgggcctcgtcatcgccattgagccatggttcatgaagaccaccgacgagatcttccaggaccagcgagacggatggacgctgcgttcggtggacggctcgcgtggtgcccatagcgagcacacgatcgccatcaccgagaacggaccgattgtgctcactgcacgcgagggtgatccgctgtcaaagctctacaactgatcgccacacacctcagattcaagcccgcagatcatgcgggctttttgtatattcaggccccgagtaccatgagcgtccactggaattctgcatatacttgcatgagatggtatattaagtgcaaacttgcgatatgagatggaaacgccgcgggcaatgtgcgtgccctatagtgttcggcaaaccgaatacggcgaatgccgacgggcgagtagaggagagctatgggagaagcgcatctgcatgtggaggccgacgaattcaagctgccggtggtcaaggcgaccgccggccccgatggcatcgtcatgtcgtcgctgcgcaacaacaactgggtctccctcgacccgggcttcctcaccacggcgcaatgcgaatccaggatcacgtatatagacggcgagcattcgattctgcgataccggggctacccgatcgagcagctgtgtgagcagtcggacttcctggaggtctcatggctgctgcgcaatggtgagctgcccacaaaagccgagtacaaccgattcgtggaagacatcaaccaccacacgatggtaggtgaggatttccgtacgttcatgggctcgttcccacgcggggcgcagccgatgagcgtcatggcctccgcaatcaacgcgctcgccgccttcaaccccgacaccaccgacatcagcgatccggaacagctcgatgaggccgccatgatcatcatggccaaggcgcgcacggtggtcagctacattctgcgcaggcgccgcgacgaaccgatgctctacccggactatgcgcgcggctacgtcgacgacttcattcgcatgtgcttcgcggtgccctacgaacgcttcgaatccgatccgctgtatgtgcatgcgttcggccgtctgctcatcatccacgccgaccatgagcagaactgctcgacgtcggtggtgcgcatcgccggctccgcgcacgcgaatctgtattcggccgtcgccgctggcatcaacgcgctctcgggcccacggcatggcggcgcgaacgaggcggtgctgcgccagctcatggcaatccgcgactccggcatgagcgtcaagcagttcgtggagaaggcgaaggtggaaggcagccgcatctccggtctcggccaccgcgtgtacaagtcgtacgatccgcgcgcggccatcgccaagcattatctcgagaagatcatggagaacaaggcgacgctcaaactgctgccaggcgacgaacagctcttcgacgtggcgttgcagcttgaggacatcgcgctcaacgacgattatttcgtctcgcgcaacctgtacccgaacgtcgatttctacaccggtctcatctaccgtgcaatcggcttcggcccctccatgttcacgccgctgttcgcgctgggacgcatccccggatggattgcccagtaccgcgagatgctcgccgacccgatgacgaagatcggccgcccgcgtcaggtgtacaccggtgccgtgctgcgcgactacgtgccgatagacgagcggtagtcaacgccgttctatttgtgtctatttgtgatagggctcgtgcgcgttgatcttgaacgcgcggtagatctgctcgagcagaatcacacgcatgagctggtgcgggaacgtcatcttcgagaagctcagcggcatgttcgcgcgcctcagcacacgcgggtcgaggccgagtgagccgccaatcacgaactgcaggtggctgacgccgtgcaatccccactgcgcgatgcgtgccgcgagctgctcactcgtcagctgatcgccttcgattgcgagcgcaacaacgaaggcaccgtcgcgcagatgcttgaggatgcgctcgccctccttctccttgatctgcgcgttgagcgtgtcggaggcgtgttccggggtcttctcgtcggccacctcaatgacgtcgaccttcgcgaagcgcgacaggcgtttgcggtattcgtcgattgcgtcgcgcagatagcgttccttgaccttgccgacgcagacgatgtcgatgttcatgtcactccttgtatgaaaaagcccctcctcagccgggatggattcgcaatgtccgcgagattccgccgtttcgcgaaacctgtttcggctgggaaggggcttttgccgtcagttcttgtgaagtgcgtcgttgagcgcgatgccggtcttgcgcggacgtgcctggatggcgccggtgagagagttgcgaatgaacaggatgttgttcttcccgctcaggtcggcgcccttgaccacatcgagtgcgaccccggccgccgccttctccttgtcccacacctcgatcttcgtgccggcggtcacatagagaccggcctccacgacgcagttatctccgagcgagatgccgatgcccgcattggcaccgagcagcgaatgctcgccgatcgagttgcgcagcttgccgccacccgacagcgtgcccatgatcgaggcgccaccgccgacgtcggaaccgtcgccgaccacgacgccctgcgagacgcggccttcgatcatgcaggtgccgagcgtgccggcgttgaagttgacgaagccggcgtgcatgaccgtcgtgccttcgctcaggtaggcgcccagacgcacacggtcgccgtcgccgatgcgcacaccggtgggcaccacgtagtcgagcatgcgcgggaacttgtcgatggcgagcacgttgacctcggcacgcatgcccggcatccccgcgcccgcattgccctgcatgacggccaggcgacgctgtgcgaagtcatcgacggcgaacgggccgtagttcgtccacacgacgttgttgagcgctccgaagatgccgtcgaggttgagcgtgttcggtttggccaggcgcatgctgagcaggtgaaggcgcaagtaggcgtcgggcgcgtcgaccaccgggtcgtcgaggcgcgagacggtgaagaccggcatacgacgcacgccgcgcaagtcctcgccctcatgaaccagattgccgaacccatggttcggcttggctgccggcgcctctcccaatgtcagtttcggataccaaacgtcaagcacgttgccggctgcatcaatgctcgccagaccccagccccatgcactgcgcgactgtgtcatcgccactccttgtctattggattgtcatatgccactgtataccgcgcacctgccgtggcgcgcctcgtgtccgttcgcggcacgtctgcccaccctatgctgcgctgtctatggcaaacgacagaccatggtcggttactgcacacgcatgcaacacaacgaccatggccgccgagctttcgtcatctgccagcaaagagatgggcgagtggaataacggggcggggtatccggttggctgaaacagaaagccacctgctacacttgcatatcgcctgtatgtgagtgacaaacaagatagggaaccgtgaaaaagcaagacaacaccgagggacgccagacccggcgcagctacaatgccacgcgcattgtggccattgttgttgtgtgcgcaatgctggtcggctttgccatgccattgatcttcgccgggctttgacgctcgcgctgttcgccacgcagccatactccggtggcgtccgctttcccgccaaggcaacgtttgcctgtgacggtatcttatatttcagttgagcaatgtgaacagattccaccgcaacggtgtttgcagtggacgagcaagtgagagattatggcagaattcgattattcgcaggcgatttccgacgcccgcgccaagtacgagtccatcgccctcgcgttggacaccgatcgtctgaagtcccaagaggccgagcttgagcagcaggcctccgctcctggactgtgggatgactccgagcacgcgcagaaggtgatgagccagctgagcgcatgccagtcccagctgaagcatctgtcgagcgccgcgagccgtctcgacgatgtggccacgctcatcgagctcggccaggaggagaacgacgccgacacgctccacgaggcacagaccgagattgaaagcatccagaaggatctcgaccagatggagatcgagacgctgatggacggcgaatacgattcccgttccgccgtcgtgaccattcgatccggcgcaggcggtgtcgatgccgcggacttcgcccagatgctgctgcgcatgtacctgcgctgggccgagcgcaatggatacaaggccaaggtgatggacacctcgtatgccgaggaggcgggcatcaagtccgccacattccagatcgacgccccgtacgcctatggccgcatgtcggtcgaaggcggcacgcatcgtctggtgcgcatctcgccgttcgacaaccaggggcgtcgccagaccagcttcgccgccgtcgaagtggtgccgctcgtcgaggccaccgatcacatcgaagtgcccgacagtgagatccgcgtggacacctactgcgcttcgggccctggcggccagggcgtgaacaccacgtactctgccgtgcgcatcactcaccttccgaccggcatcgtggtgaccatgcaggacgagcgttcgcagattcagaaccgcgccgccgccatggccgtgctccagtccaggctgctcgtgctccgccatgaggaggaggccaagaagaaaaaggagctcgccggcgacatcaaggccagctggggagaccagatgcgctcctacgtgctgcacccgtaccaaatggtgaaggatctgcgcactggttgcgagacctcgcagactcaggcggtgttcgatggcgacattgacgagttcattcaggccggcatccgctggcgccacgagcagcggctcgaagccgcggccgaggaagccaacgagtaaatcgcggcccggcggcaagcgatgcaagcagggaggaagtagcccatggcactcatctcaatggaacatgtgagcaagatctatccgaatgccaagagaccggcgttgcaagacatcgatcttgagatcagccgtggcgagttcgtgtttctcgtgggcgcctccggttcgggcaagacctcgttgctgcgcctgctgctgcgcgaggaggaggcgaccagcggggagatccgcgtgggcgggtacgacctgcgtcgcctcccgaaccgtcaggtgccgcagtaccggcgttccataggcatggtgttccaggactacaagctgctcaacaacaagactgtgtgggagaacgtggcgttcgccctcgaggtgatcggcacctcacgttccacgatcaagtcgctggtgcccaaggtgcttaagacggtgggtctcacgggcaaggagaacaactacccgcgcgagctctccggcggtgagcagcagcgcgtcacgattgcgcgcgcctatgtgaaccacccgcagctgctgctcgccgacgagcccaccggcaatctggacccgaccacctcgctgggcatcatggaggtcctcgatgcgatctcccgaaccggcactaccattgtgatggccacacacaacgaggagattgtcaactcgatgcgcaaacgcgtggtcgagctcaacaagggcagcattgtccgtgacgagaagaacggctcttatgattccgccatgtacttcccggatgagcaggtggccgcgatgtcgcatgcggcgatcaaggccgaggtcggcatcggggccgtggctggcagtgaaaccggcgcggtgatcgaaccggcaacgaatcagcagaagtcgcacagcggcaagcatgagcgtgatgaacgggcgaccaccatggtcgactcggtcaatgagatcctgcaatccgagcacagcaacgagggcatagcccgtctggcccagagcgtgcatgccggcaagaccggccgttacggcgaggcattcgcagatgtcgaacagacgctcacctggggtggaggcctctctctcgaggagctcgccgaacaggagggcatcgacaccagcaagacgcgagaggtctcgaccgccgcaaaggcggacgcctccatggagcaggattccgggaaggcatggggaaccgtgaccctcgaggagccgcggggcgaagccgactccaccggcaatgcctccgctgggaagacgacgcccgtcgaacagacgcaggcgatggcccccgtgacgaaggagatcgaaccatccacgccacctatgccaccgagtccgccgaaggggcggcattcgcgaccgagaaccccggatgagccgaacaaggacgaggagtagagcatgcgattccgtttcattctttcggagacatggacgagccttagacgcaatgtgcccatgctgctttcggtgatgctcgtcacgttcatctcgttcctgttcatcggggcatcgttgctcactcaggcgcagatcacgaaggccaagggcgattggtacgacaaggtcgaagtcgtggtgtggttgtgcccggacggcaacagtcagtctgcgaactgctccacaggcaaggctgccactaccgcgcagatcaacgagctgcagaaggtgatccagcaggaattgccgaacgacgtctcgcaggtcacgttcatgagccgtgaggacttctacaacaactccttcgtcaagcagtacccgaagggcgaataccaagggcgcacgctcactgcggccgacatgcaggattcgctgtggctcaagctcaagaaccctgagaactatcgcgtggtctccgaggtgctttcgaatcgtgatggggttgaggaggtggttgaccagcggcagatcttcgaaccggtgttcgccatactcaaccgcgccaccgtggccaccggaggtttggccgtcatcatggtgatcgcggcgatcatgctcactggtacgacgattcgtatgtcggctgcgtcgcgaagagaggagaccgagatcatgcgcttggtcggcgcctccaactggaccatccgtctgccgttcattctcgaaggcgtcattgcctcgctggcgggctccctgctttcgtgcggtgcattggcattgttcgtcaaggtgttcgtgaccgactggctggcgaagtcggtgacatggattccatatgtggaccagaccacggtgtggcttgtctcgccgattctcattgtgggtgccatggtgctttcggtgcttgcctcgtctatcgccctgcgtagatatctcaaggcgtaacggctcgtgttttccgcgattccattggcattgccgctttgttaattgtgcagattctgtgaatgagttgaatatggcatggcgtccgcccattttcaagaatgtgatgatacgctggtgagcagcgtattagaaagggactcgatgacgaacaggaaacggaccgtacctgtagtggcatcctcgctggcctctgtcctatgcataggcgcattggcggtgccgatgtcgacgtacacgcctcaggcatacgcagacacctacagtgacttggtgaacgcccagaacagccatgcccagagcaagcagcgcgaggcggcgctacgtgaacagctcgccggagtgaacagcgatctggccgacaagatcgtggaactcgacgacctcaacaacaacaagatccccgccgcacaggccaaggtgcagcaggcgaactccgatgccgcagcagccaagtccgaagccgatgccgcggcggagcgcctcaaggccgccgagaaagacaaggccgatctcgaggccaagatcaagcagaccggcgaggactacgacgacgcacatgccgccgtggcacaaagcgctcgtgagtcgatgcatggctcagacacctccgatgtcatgagcgtcatgaccggctcgaaggacacgaaggacttcatcaagtcgatgcaatcgcgtgacgctctcgcccgtaacgaggcgaatgcggcatccgatgccgccgtcgacctcaacacttcgatgaaccgcgccgacaggctcaaggcaatcgagaagcgagtcgagcagtgcaagaacgacgccgatcagaagtccgccgccgcacagtccgccgcaacgcaggcccagcaggagaaatccagcctcgacaaactgcgtgcagccggtgagagcacacgagccgacctggaaaaccagaagagcagcctcaccacgcaagccgcccagcaggccgcgcagaccgtgatgctgcagtctgagatcgatgcgaagaaccagcagtgggccgccgaacaggctgccgctgcggcgcaggtgcaggaacctgagccacagggtaccgtcgaggcacctgctgctgcggcaccccagccgtccgttccccagcagacgcaaacgccgtcccagccggcgcagactcagcgtccgtccacgccatcacagccgtccacgcccccgactccggtcgtcacccgtccctctacgggcggccagggcacatcgaacggcgattacgggaatgcatacgcagcaggccagtgcacgtggtgggcctatgagcgtcgcaagcagatgggcatcggcacgccatcgtatctcggtaacggcggccagtggtggagtacggccccgtcgtacgggttgcgcgtcgaccatagccctcaggtcggggccgctctgtcgttcctgccggggcaggagggcgcctcgagcccatggggtcatgtcgcggtggtcgagcaggtcaacggcaacagcatcctcatctcggagtcgaatgtggccggtctgtacaccatcacataccgtacgctgtataatccgggacggttctggtacgtccactgacagccgccaataaccaagcatccattcggggcccgatatcacagtatcgggccccgaactcatatgcgcaccttccgctaggcaatcctcggctgcaaactctcattttctcatccgcgttctcatctgcgtggtccccagatgagtagtcgtcatgtgtgtggttctcagatgggtggccttcatcagtgaggccttcatctgaagagtcctcgtctgtgtaatcctcgtctgcgtaaaaagagacgaatctagtccctagatgtctctttttacgcagagagtggaagaaggtgaaggggagataagggccggcggcatgggaaagcgggacagtcgcagaagaacgggggactggtaggtagactggttcccagaacaatcgaataggagcaactgtggcgaagaaagagcagagcaacgagaagatgatcgcgcagaacaggcgcgcgcggcacgactacgagatcgaagacacctatgaggcgggccttgcgttgacgggcaccgaggtgaagtcgctgcgcgaggggcgtgcctcgctggcggagtcgttcatctcgattgacaagcggggtgaggtgtggctcgaaggagcgaacattcccgaatacctcaacggcacatggaacaaccatgcgcccaagcgcaaacgcaagctgctgctgcacggcgcgcagatagacaagctgcgccggcagattcaagcgaagggctacaccattgtgccgctgcagctgtatttcaacgaagacggccgcgcgaagctcaagattgcgctcgcccgtggcaagaaggagtacgacaagcggcaggcgttgcgtgaagagcaagacaagcgcgaggcgttgcgcatgatgcgctacaagaacatgcatgcccgcggctgactcctgaatccgtgaatctgcgtaaaaagggacaaatatagcctgtattcgtccctttttacgcggggaagcatacgcatgcaggggaagtgtatgcgtgcgggggaggcgtacgcagcggaggtgtatgcaggggaagtgtgcggcacggaagagatgacgcatgggttcgtgcgtaatttgggtcgatctttgcgcatagttgtccctttttacgcagattggcaacgtgagctgtgtgtgggtgacgccacattcgagagattacttccagattacgagattcctcgggtgccgaaacgcgctgataacatgtgattcctaccctgactcgtgtttgaagccgaacacggaggagagagccatgaagaacacttggaaagccacggcggcatttgctgccatcgtgttgtgtgcgggcatgtcagcatgtggcaccagtgatgcaagcgacagcggcaagtccagcggcaccagcagcagctcggcggccgcgtcgttcgacccgagcactgtggagaccgacgagacgatcgccgcactcgtgccggactatgtgaagaaggacggcaagctcaccgtgggcaccgacaccacgtatgcgccggcggaattcattggggaggacggcaagaccgccgtcggctatgatgtggacctcacgaaggcgatcgccaaggtgatgggactcgaaccggagaccgcggtgtcggaattcgacatgatcatcccgtccatcggcagcaagtacgacattggcatttcgtcgttcaccgtgacccccgaacgtcaggaggccgtcgacttcgtcacttactacaaggccggctccacgtgggtgacccagaagggcaatcccgacaaggtcgacacgaaggacctgtgtggcgtcaaggtcgcagtgcagaccggcaccacccaggaggaggagctcaacaagatgaacgagcagtgcaaggccgatggcaagaaggccatcgaactgcagaccttcgccaagcagaccgatgtgaccaccgccgtcgttaatggcaaggcggccgtgttctatgcggattcgccagtcgccggctatgcgatcgagcagaccgatggcgcgctcgcaccgctgggtgccgacgaaggcgtgaccgaggaaggcatcatcgtcaagaagggcgacaagcagatggatgaggccgtccagaaggccgtgcagaagctcatggacgacggcacctaccagaagatcctcgagaactggggcgtgagctccggcgcgatcgacaaggccgagatcaacccgaccaagtgagcgcacgaatccgcacgctgaacgcaatctgacatatattcgccgtcggcaaacataagcatcgcataatatgcatatctaggcatatgtatacagtgtaagtgtttgaaaacggcgactatttttgccatagttgcttgagaatactgaatatatgcagaacttcgccatgtggagcacatggcaggcacatgaggaaaaggaacgctgacacatgtttggcaacgcacaatccacgatgaagaaggtcgcggcattcgcacttggtgccgcagtcatactcggttccgcggcatgcggtacgactgacgaaacgcagaccgcggcaaaggactcgcagaacgcgacctcgattgtcgactcggtgaagaaggacgacaagatcgcggccatgctgccgcagaaaatcgccgagtccggcaaactcaccgtcggcatggagatgacctatgcaccggcggaattcgtggcggaggacggcaagaccccggaagggtatgatgtggacctcgccaaggcgcttgccaagaccctgggcgtgaaggcggacttcatctcgtcgagcttcgattcgatcgtgccgagcgtgggcagcaagtacgacctcggcatcacagcgatgacgatcaccgaggaacgtgaggattccgtcgatttcgtgagctactacaaggcaggctcgatgtgggtggtgaagaagggcaatcccgacaaggtggacgccaagaacctgtgcggcacgaagatcgcagtgcaggtgggcaccacgcaggaagaggatgccaacaagatcaaggaacagtgcgccgccgatggcaaggccgcggtcgaggtcatgccgagcaagcagcagaccgatgccgcgaccaacgtcgtgaccggcaaggcggacgtgttctatgcggactcgccggtggcaggttacgcgatctcgcagaccgacggacaactcgaggaactcggtgaggtcgaaggaacaatcaagcagggcatcgccatcaagaagggcgacacccagctcgccgaagcggtgcaggcggccatgcaacatctgatggacgacggcacctacatgaagatcctcaaggcgtggggcgtggagtccggtgcgctcgacaaggccgagatcaatccgaaggatttgagctgaagaatccgaacgcgtgccggccggccgcatatggaacgtgcgaatcagacgtgagccatatgcggtcggtcggcgccgttgcgtaacggggtacgttacaatactcacatatcgtaggtagatgtctggaaccgcaacggcgcaagccgggcgcgcacggccgaatgccacggaacgcagagaagaaggaagggcgatgccacatcacgttgaacacgacagcgaagggctgccgatccccaatcgcatcaaagccaagccggtcaagcgcccgggccagatcgtcgccgcgatcatcgtggtcatcttcgccgccatgatcgtcaagggactcatcaccaacccgcgcttcgaatggaacgtggtgtggaagtacctgttcaatgagcgtgtgctcgaaggcgtgggctacacattgctgctcacggtgatctccatggtcgtggccatcgtgctcgccgtggtgctggccgtcatgcgcaaatcggtgaatccggtgctccgcggtgtcagctggttctacatttggttcttccgcggcacccctgtatacacgcagttggtgttctggggtctgttcgccgtgctcatcccacgtctgtcgctgggcattccgctcacgtcggtggagttctggagcatcgattcgcaggcgatcataaccgcgttcaatgcggcatggatcggtctggcgttgaacgaggccgcatacctggccgagatcgtgcgcgcgggcctcgacgccgtcgatcccgggcaggaggaagccgccaaggcgctcggcatgaagcgttcgatgatcatgcgccgcgtgattctgccgcaggccatgcgcattatcatcccgccgaccggcaacgagacgatcggcatgctcaagacgacctcgttggtgctcgccgtgccgttcaccctcgatttgcagtacgcgacgaacgcgatcgccaaccgcatctacaagccgattccgttgctgctcgtggcctcgatctggtacctgttcatcacctccattctcatggtgatccagtcgatgctcgagaaacacttcggcaggggattccaagcgcgtccggtggggcccaagggcaagcagccgccgctgccgggaaagacggacggcgagccgaaagacgacgtgaataagacgaaccaggccgaattcatggggtataccgcctagcggtgccgtgggcataaggagagacacatgagcgaagcgacgagaaaaaccaagtcgaacagcgacgaatccactgcaacgcaaaccccgaaagccagcgtggccaccgacatcgccgccgcgattccagccgtggaggccaagcaggtgcacaaggcatttggcgatttgcacgtgctcaagggcatcgatctgaccgtcgagccgggcaccgtcactgtgattctcgggccgtccggttcgggcaaatccacatttctgcgtctcatcaaccagctggagacgatcaccggcggcgagatcgacgtcgatggcgagatgatcgggtacaagaaactgccgaacggtgaattgcagacgctgaacgacaaggagatcgcccgccagcgcgccaagctgggcatggtgttccagaagttcaatctgttcccgcatatgaccgcgcttgaaaacgtgatggaggcaccggtgcacgtgctgcacatgccgaaggcggaggcacgcaagcttgccatcaaggaacttgagcgcgttggactcggcgaacgtctcgactactacccggcccagctttccggcggtcagcagcagcgagtggcgattgcgcgcgcgctcgccatgaagccggagatcatgctgttcgacgagcccacgtcggcactcgaccccgagctcgtcggtgaggtgctcaatgtgatgcgctcgctcgcgaacgacggcatgacgatgatcgtggtcacgcatgagatcggcttcgctaaggaggtcgccgaccagattgtgttcatggacgggggagtcgtggtggaacgcggcacgccggacatcatcgatcatcccaaggaggagcgtttccaggacttcctgcagcacgtgctgtgatccgtgcgccgctcgtattcggacactccgtgtgagggtcggcttgcaaagatgattatctgggcgttgccatgtgcgctttgttgagtgcggagttgcaaaggtggccatcagagaggcgattcgtttgccggtgcggaatctgcactgcaagcgagaccatcgtggaagctgataggtggtcgtgtttgcagattcgctctcgctcacgcaaaagtagatcccgcatggtggttcgtgtgggagtcggcatgcgaaagcggcaatctgcagactcgtccgtttgctggagcgcggcccagtgtgcaagagcggcaacctggggactgattcacatgtcgcgggaagattcagtttgcaaaggcgaccgttaagaaataatctgcatgtctctgtgagaacggaattgcacaagcgacaatatgagcgcatggaacagcggccggcgcaagacatatatagctcggcgcgcggctaggagacgtagggtactcctgcttgctcgagtttgcggcgaagctgatcggggtgcatcacgtcgttgtatgagaaatgcacgatctgcgaaacgccgcagcgacggagcgcctcatctcgctcacgttctgccagcacgcgctgctcaatggtttttgatcctaccatctgcggattcacgtatttctccatgccatcgaactcgccaacaatggctctgccgtcggccaatcgccacaggtaatccgtgcgatatgtctttcttgtcacggggtcgaaaaaactgatctgcaattccggaaccacaaaacccagcacaataatcacggcacgcgccttcgattcgccgccgctctcactgcgaggatctgcgaaatgcaacagtcgtaagacgggactcacatcacgcgacatggttcccatgacttccatgatctgtttgaagtgcgtggtggacgcggaatcgaacatcggcagcgtttcttcgaaaggcagcaacaaagcgcaatctaccaatgtgtgtgccggattcgtgaccagcaatccctgcatgctgattgccgagtccatatccgtgtaaatatgctgagtccgttcggaagtccagtttcgtcgtgcggcacagacgatcgtgccgtcgtgcactgcgtggctcaatgggaagccaagcagggtggcggcggtcttgccggcaaataccacgccgggattgtactgattcaccgtacggcagatatgccatgttcgctctgccgggcgcagggaatcccagtaatctggccgcacataacaattcctgaacacttggttgagctcgccggatctcgctctgcgggctagcgcgactcgctcgttgcgattgcatgcatatgcgcaacgatgtccatgctgggcggagtcaagcagttgctcgaccactctgttcctgcgcatctcgcctcctttcgtgtggcatgtagccatctaagcagcgtggggcggtggtgtacagcggaatcgggcattgtggtcggaggacgcattattcacaacggcggtcgtcgcaattgtggacagtcacgtgcacgccctgcaaaagcgctggcaagaagacgagcgttgatgaagtctgtcgcgatggattgcgggatgtcttgtagtggtttcagatgcaaagatgaatatcgagattgttttcacgtgctatatcggagttcattttgcaaaggagactcttcctgaacctcttcgtgtgtcgtagtaggacctgatttgcaatagcggtcagatagcggttgttcatattgcaggtagagcaaatgaaatgcaaggaaagcaatatgagcactgattcgcatgccgcggtgaggcttattcgcaaaggtgactatcgtgattctgctgtacatgcgcagttggtagcggagttgcaaagccggctatcgagatcttgttgcgtgtacgcagttgagggtgagtctgcaaggatggctattgggattttgctgcaagtgtccagccgggagtggagttgcaaacgcgactggcggaatctagctgcagatgttcaactgagtgcggagttgcaaaggtgactgtggaaatcctgttgtgctggtccagctgggagcggagttgcaagtgtggtcaggcaagagagtttcgtttgctgtgacgagattgcgattgcaaaagaagcaatctgatgagttaccagagggtcatgtttgcagattcgctctcgctcgcgcaaaagtagggcccgcatggtggttcgtgtggggttcggtttgcaagagtggcagtttgcaggcttgtctgtttgctggagcgcggctcggtgtgcaggagtggcagtctggagactgattcacgtgccgtgggaagattcagcttgcaaaagagaccgctaaggaattctttctatgcccttatgagagggaatctgcaaaagaggtaatcctccttatatgcttatatgccgcggtgggactcggagtgcgagagcgacactctaaggagcgtcgcgatgccgtaatgcggttcagtttgcaaaaatggcactctggaatcgtctcacagtgttgtacgtgcccttatgctgtatgcgtctccggctgcatatcgagtggccgcatatcgagtggctgcgtaacagggaagagagagccgcgagtgcgcagtctcacaccgcattccatcagcattgcggattagcacagcgcggtgcctcctcacagtttgttgagtcagcccatttccacgatgtcatcaaaggaaagtgccgcgggcatccgtgccccttcgcacggatgcccgcattgccctagaatctcgcctacgggggagatgcccttctctctcgccagttttcattgtaaaagagcggcattataaaaaccattgattgtagtcccacagactacaaaactgctcggcgtgtcgaaaattcacagtttcgttttgcgggaccatgacgccaccgcctcagcccgtgatttcgcgcggagtttgcgcatggcgcggctgatgtaggttttcaccgtggattcactgtcgccggtctcttcagcaatggtgcgcgtggaaagtccctccgagcacagctccatcacggcctgctcgttcggtgacatgctcatgattgcaggtttgccttgcatgagcagtctttcgtgtgcctgctgcggggtctcgtatggcatgccgttcgacttgagcaacggctggccgctcaacaatgtacgcattccgtcggccagttgagcgagttcgtttttgagcagcaggccctgcatgccattgttcaccgcgtcgcgctcgtacggctcgatcatgtaggaactgcatccgagaatgggcgtatggtcgttctcgaatcggattgtggcgcatagttcgaaccccgacatgccgtgcatagacaggtcggtgacaatcaaatccggcacacagttcgtgcaggcgatgctgtggtggtatgcctccacagcatcccttccgctttgcatggaccagcagatgttgaactcgggcagccctcccaaataggtttccaagtagctgcgcaccagcgcgtcgttgtccaccagggcaatgttccacggttcagaatcggggttcatattggtatacataacgtgtaactctcttcgcggcaggcgaattcgtggcgaagcgggcgcttcgtcgcgtcacgtattcggctcctgctcattacagtgtacttgagcagcatgtgatttgcgcgggttgattgccatatgagccatgccataccgtgtttcagatgagtattgagatattcaacggtattcgatgtgcctaatttgcagattttcgtaagacttgtcgttttgccctgatggtatgggcttttgcagcatcttctgttatgctgttcggcatgtgtggaattgtgggttatgcaggtagtgttctttgtccttcggataagccgcttgaggtgtgtttgcagggcttggagcggcttgagtatcgtgggtacgattcggcgggtgtggcgctggtggcgccgggcatggatcgggtgcgggtgaggaagaaggccggtcgtctgagcaatctggtggcggatatcgagtcggatccgttgccggaggcgacggtggcgatcgggcatacacgttgggcgacgaacggtgtgcccaatgatgtgaacgcgcatccgcattcgagcatggatggcagggtcgcgatcatccataacgggatcatcgagaacgcctcgcagctgcgtttggatctgcaggctgaggggtaccggttcgtgtcgggcaccgacacggaggtggcggccaagctgctgggcaagatcgtggacgcggtgattgcggagacgggcgggccggacctgttcgaggcggtgcgccgtctgggccgcatgctcgagggtgcgttcacgatcctggcgatcgactgccgccagccgggtgtcgtggtcggtgcgcgtcatgattcgccgctcgtcgtcggccttggggagggtgagaactacctgggttcggatgtggcggcgttcgtcgcgtatacgaggacggcgatggagatcgatcaggaccaggcggtgatgatcagcgccgggggtgtgacggtcaccgatttcgatggcaacgtggtggaggatcccaccgtgttcgaggtggattgggatgcgtcggccgcggagaagggcggttgggattcgttcatggacaaggagatccatgaggagccggccgcggtgcagcgcacgttgatcgggcgcctggacgataccggcagcatcaacctggacgaggtgcgcatcgatgagcatgatttcacgatgatcgacaagatcatcgtgatcggctgcggcacggcgtcgtatgcgggtctggtggccaagtacgcgatcgagcattgggtgcgcatcccggtggaggtggagctggcgcatgagttccgctaccgtgacccgatcctgacgccgcgcacgctggtggtggcgatctcgcagtcgggtgagacgatggacacgctgatggcgttgcgtcatgcgcgtgagcaggggtcgaaggtgctggcgatctgcaacacgcagggcgcgtcgatcccgcgtgaggcggatgcggtgctgtacacgcatgcgggcccggaggtggcggtcgcctcgacgaaggcgttcgtcgcgcagatcacggcgacctacgtgctgggcctgtacctggcgcaactgaagggcacggtgttccgcgacgagatccgccaaaccctcgactcactcaaggccatgcccgccaagatccaatgggtgctcgacacgcagccggaccgcgtgcagcgtgccgccgagcaactgcaggatgcgcagtccttcctgttccttggccgtcacgtgggctacccggtggccttggagggcgcgttgaagctcaaggagatcgcgtacacgttcaccgagggcttcgccgccggcgagctcaagcacggcccgatcgcgctggtcgacgagggcgagccggtggtgttcatcgtgcctcccgcgcgcggccgcaacacgctgcatgcgaaggtgatctcgggcatcgaggaggtcaaggcgcgcggtgcgtacatcatcgccgtggccgaggagaacgacaaggacgtggaacgctacgccgacatgatcttctggcgtcccgaatgccccacgctcatgagcccgctcgtcgacatcgtccccctgcagctgttcgccatggacatggccaggcagaagggctacgacgtcgacaagccacgcaacctcgccaaatccgtcaccgtcgagtgaacggcgctcatcgctgggtgatcgaggaaccgcacatcccgttcgatctcacggtggtctatgagaacgagcgcatcattgtcgtggacaagccgcattttctggcaaccacgcctcgcggcatgtggtatcgcgaaacggcattgatgcgcttgcgcgaacggtatcgggagccgaatatcatccccgcacacagactcgaccgtcccaccgccggcattgtggtattcgtgcgggaccccgctgcccgtggcgcctatcagatgctgtttcaggagcatcgcaccaggaagtgctatgaatgtctggcaccgattcgtccgcttgccacgccccgcaccggcaccgtcgtgcacgggtcacctccgcgaatctggccattggtgcgccgctcgcgtatccgaaagacgaggggcgtgctgtgcgcgcaggaaataccggggcaggtgaatgcggagacggcgatcgagctcgaagcattgcatgcccgcatgagtgcgcgaatgggcatgtcgatcggcgtataccggcttcttccccgtaccggcaagacccaccagcttcgcgtgcacatgaattcgctggggttgcccattgttggcgatgatttctacccgcgcatagaggaacgagcctacgacgacttctcccagccgctccagctcgttgcccgttcgttggccttcaccgacccgttcaccggcgatccgctcgaattcagctcaaagattgagctggggatctagattctatactgttgtcgaattcgaaggacggggagacatgaacgcgcagatttggtatgtggttttgctcagcgtaaccgtgatcgccgcgctgatcggcacctccattgtgctcgggcaatcgaagaacgggccaggggaggatcattacatcgatctggatccgcagatgcagggcgagccctacgccacgcctgtcatcgtgggagacgacggcgtgacacggcagaaagacattgtgcatgacatcaagcagatgccagacgacacggcgattgtcgacgtgctctacgccggctcgaagaaaggcagcaaggacgatacgaaggctgagcacatgacgatgaagaaagtggatgttcgccgtcttggcctcaaacccggcaccaccgtcaccctgcatgttgtggatggtgcaatcacgctcatcgagcggtgacggaggtcacacattcttcgcgtagatcgaggccatgcctttgaagatgagcgtcgggtcgacgatgtcgatgagcgggcagtcgaagatgcgcgacatgccaccggtggcgaccaccttgaaatcggtgtcgagctcctcgcggaactgtgtgatcgtgcgttcgatgccacctaggcagtcgtagtagagtccggcctgcatggcgtctttcgtgttggcggcgagaatcgatttgggtcgtgtgatctgcacttcgggcagctgggcggtgttcgaggcgagcgctgcagccgcggtgccgatgccggtggtgatgagtcctgcgagaatggcgcccttctcgtcgacgtagttgtaggtggtggcagtgcccatgtctatgaccagcaccgggccgccataggtggtgtaggcacctgcacagtcggcgagcaggtcggcgccgagggagcgtgggtcgtccatgcgaatgttcatgccggttttgatgcccggaccgatgatcattgggtcgatgcccaggaatttgatcatcgaggagatgaacgaatgcatcactttcggcacaacggaggagatgatcgcgtcctgcacgtcgtcgggcgaggaattgctcagttgcaggaattggaggatcatgaggccgtattcgtcggacgtgtggttcgaccgtgtggtgatgcggtaggtgtcaacggtctcggtgccctccatgagaccgatcacaatgttcgtgttgccgatgtcgactgccagaatcatgcctgctccttgtgctcgatgcctccaacttagcagacgacccgacgtccgggcggccggatgcgatacaatgatcgcggtgaccgacccgccgaggcggtcaaccgacaaaaccatgcagcatacgggcccagtgcgccctatgccgcatatgaacattagaggtaccatgacagaaccgaagaacggcttgcagaacaacaatgagccgaagccgcagaacgccgacaatgcgtctgcgagcgagaacaaggctggcaacgcaagcgcagccagcaccgatgcgtcattgcaggcgcacgagaaaagcgggaacacgcattcgggttggaaaggctgggtgcttggcgccatagccgtaatcatcgtggcggcaatcgtgttcgccgtggtgaaccatacgcgtgcaggcaaggaatctgcaatccagacgggaacgccggcacagacggtcacgatcgggctcaagctggcgccgacgaatctggacattcgaaacaccgcgggctcgtcactcgatcaggtgctcatcggcaacgtgtacgaaggactggtgagccgcaacgaggagaacaaggtggtcccagcccttgccaaaagctgggaggtgagtgatgacggtctcacctacacgttccacctcaataagggcatgcacttctcgaatggcgatgagctcgatgcggacgatgtggtgtggtcgatccagcagctggaggagaagcagtaccatgacgcggacgcgctgcgcaacttcaagtcgatcagcgccccgaacgcagacaccgtggtgatcacactgaccaagccatactcgcagctcctgtgggcattgagcggacgtgcgggtcttgtgttcgacaaggacgccaagtatgtggcgaagacgcaggcagtgggttccggcccatacaaggtggccaagttcacgccgaacaactcgatcgagctcgtggccgacgagaactactggggatcgaacaaaccgaagacgaagaacattgtgatccgttacttcgccgacgacaatgcagccgtgaacgcgctcaaatccggcgatgtgcaggtgcttgcgccaatcacttacgcgcttgccgaatccgcgctcgacgcccggatcgaaaccaagtcgtcggattccaacggcaccgagcactccaaggagtcgggcgaccccacctcgcgattcgtggtgaaagtgggcgacggcaccgacaaatacgtgcttgccatgaacaacgccaaaggcaaagcgactgccgacaagaaagtgcgcgaggccattcggtacgccatagaccatgaccagctcatcgcctcgcgcgggggcgtggatgccaagctcggcggcccgatcccctcgctcgacccgggctaccgggatctgagctcgaagtacccgcacgacatcgagaaagcacgcgaactcatgaagcaggccggctattccgccgaccacccgctcaaactcacgttgacctacccgaacacctacggcaccgagctcggcgaacagctgcgctcgcagttgaaggaggcatacatcgagctcaaggtgaacgtggtcgaattctccacgtggctgcaggacgtctacaccgacaaggactacgacctgtcgatggtggaccacaacgagagccacgatttctcgcagtggacgcggccggactactattacggctacgacaaccggaaggtgcagcagttgtacgaggaggcgatgggcgccacaaacgacgacgagcgtgatgccaaactcgccgaggccgcgcagaccgtgagtgaggatgccgcggctgactggctgttcaactaccgcgtcgccacggcgatgggcaagggcgtggagggcttcccactcaacatgaaccagacgttcatgccgttggcgcagctcacctacacgccaactaagtagcaaacggcctcataacggtctcaaaggacgcgtgtcttcatgaaatatgtgttgcgacgcatcgccatgttcctggtggcgctgttggcgatctcgctcatcgtgttcctcatgctgcgcgtgctgccgggagacatcgccgccgtgatggcgggcacgaactcgccgcccgagcgcgtggcccagttgagggcccagatggggctcgacaagccgcttccacagcaatacttcgagtgggtcggcggactgttgcacggcgacttcggcatgaccatgctcaccggccagcccgtggcttccgtggtcgcctcgcgtgccgccatcacgttcccgctcattgtgttgggcatgctggtggcgctgctgttcggaatcccgctcggctacctcgccgtgcgcacgacgaaccgtgcggccaaggcactgttccagaccatcgcgatcattggaggcgccattccggccctatggggcggtctgctgctcattctgctgttcgcgcgcggactgggcgtgttcgaagtgttcccggcgcagggattcccgagtcgtgggtggaccgatccgtcccgcgcattgctcagtctggtgttgccggcactcaccgtgggcatgatcgtcggcgccacgatcatgcgttatacgcgttcctcgttgcagaccatcgcctcctccggctatgtcgagatggcgatggcatgcggcatgacgcgcagacaggcgttgtggcatgtgggcatgcgactggcgatgccgcagctcgtctcagtgatcggcctcactttcgccgagatggtcaccggagtcatggtgatcgagaacctgttcgcattgccgggcataggcaccggcttggtgagtgatcttggccatcgcgacctcattgccgtgcagagcgagctgttcatgttggccgcgttcttcctggtaatcggactgctcgtcgacctgacacaccgggcactcgacccgcgattgggggaggggagcaatgaataggcaatctgtacgcacgcactttcgccgcgtgggcatcgtcgtctcgacgatgtggtcgcgcggcaccggcaggttctcgttgatcgtgctcggcctgtgggtgctggtctcgctcgtctcgctgttctggaccccgcggtctttgtggcaaaccgatggctacaacgtatgggcgaaaccgtcacgcgagcactggctcggcaccgatggcaccggtgccgatgtgctcagctggctcatggccggctcgcgcacgaatctggccatcgtggtgctcaccgtctgtttcgccctcgccttcggtctgctgctcgtgtcgctgatggtctcgcacagcacattgctggcgaacggaaccgtggtggcgattgacgcgctcatctcgattcccaccgtgctcatcgcgctcatgctcgccgtgccgcttggcgcttcgattctgggcattgtgctcgcctgtggtttcgggtatgggctcaatctcgcccgcgtcgcccgcccgcaggccatgctttctgccagaagcctgtatgtggagtcggcgctgtcgaacggcgcgtctgcggcacgggtgttcttcacgcatgtgctgacgaacattcggccggtggtcacggtgcagtgttcgctcgccgcaggaaccgcggtgttggcggagacggggctcacctacctcggtgtgggtgtgccgtccggtgtgcccagttgggggtattcactcgcctcgtcggtcaagttcatcacgatctacccgctcacggttgtgtggcccggcctgatcgtcaccgtggtcgtcatggcgctcaatctgttcggagacgcgttgcacgatgccgccgacccgctgagcaacccgaggttgaggagggtctcatgagtgtggatctgcaatccgtgaatgtgtcgattgcgggcaggcagatcgttcgcgatgtctgcctgcagattcgcgacggccagcgtgtgggactgatcggctcctcaggctccggcaaatcgatgattgcacgggcgatcatgggactgctgccgcaagacacccagctgagcgggtcgatcaatgtgaacggcacgcagacggttggcatgaacgacgtgcaactcgccaggctgcgcggtgcggcgatgggcatggtgttccagaatccggcggcttcgctcaacccgctgttgcgcgtgcgcgaacagatcgagcttccgctcaagttgcactacgatctgcctgcgcaggaccgcgccgaacgtgtggcgaacatggccgcgaaagtgggtctgccggccgatgtgctcgacagattcccccaccagctttccggcggccaacagcagcgtgtgagcatcgcgacggcgctgatcacgtcaccacgcctgatcattgccgacgagccgaccaccgcgctcgactcgatcacccagcagcagattctcgaattgctcgtcggactggtcgatgaggccggtgcgtccatgctgttcgtcacgcatgatttctccgtgctggcgagcgccacccagtactgttatgtgctgcgggaagggagtattgtcgatgccggacgcaccgatgcattgcttgcagacccggccgacgaatacacggcaatgctggtgacggccgcgcgcgcactcagcctgcatgtcgacggtagcgggggtgccaatcatgattgaggaacagcagaagccggccgcgctgcaggcaaatgcagcggtcaagagcttcggaagagggcgcgggcgccatcaggtgctcttcgacgtgaatgtcgaggtatggcccggcgaatgcctggggatcatcggcgcctccggttcaggcaaatcgaccctcacgcgcatcatgttcggcttggaacaacccgattccggtgatgtgctgttcaacggcgtcagcattctgggagcgagcggtcgtgcccagctgcgcagcttacgggcagcttcgggcattgtgtaccagaatccgttcgcctcactcgacccgcgctggacggcagggcgttcgattgcggagccgttgcgcctggcgggggaacgcgacgagcgcggtattgggggccaggtgtcgcgagccatggaattagtgggcttggagccatcggagttcatgggccggtacccgatggacatgagcggaggtcaggcacagcgtgtggccattgcgcgcgcagtggtgaaggatccgcaggtcatgttggccgacgaggcgatgagcgccatcgatgtggcggcccgcatgcagattctcgatgcgttcgcggcgattcgcgaacgtgacccgaacatggccatggtgcttgtctcccacgacctcggcgtggtgcagaacatagccgaccgcatagtcgtcatgcatgaggggcgcgtcgtggaaagcggcccgtctgcgcagattctcgagcagccgcagcaggagtacacccgtctgctcattgcggcagcaagtctgtgagtcagtcttctgaaaagggggcctgtacccccaacgacggttatggggtacaggccctctgctcaatggaatggtgagctcatactgtttcagagctgctgcagtgcctgctccaagtcggcaatgagatcgccgtcatcctcgatgccgatggacagacgcacgaggttggcgggaacctcgagtgttgtgcctgaaacagaggcatgggtcattgccgccggcacttcaatgagcgattccacgccgccaagcgactcggcgagcgtgaacagccgcgtcgaggaggcgaaacgctgtgccgcttcagggccgccggcaagttgcactgagatcatgccgccgaaaccgccatgcatttgccgcgcggcgatctcgtgacccggatgggactcgaggcccgggtaccagacgcgctcgatctcggggcggcgttccagccattgcgcgatttccaaggcattcgcactgtgtttgcgcacgcgcaggccaagtgttttcaatccgcgaatgtcgagccacgaatcgaacggagacggcactgcgccggcggcgttctgcaggaaggccacggcgtcggcgacctcggggtcgttgacgagcaccgcccctccgaccacgtccgagtggcctccgatgtatttggtggtggagtacaccacggcgtcggcgccatccgcgagcggatgctgcagaatcggtgatgcgaacgtgttgtccaccaccactttcgtgccgtgttcatgggcgagctgagccgtcaatgcgatgtcggtgatgccaagcagcgggttcgatggcgtctccacccatacataccgatacgatttggcacccagggccgcattcagcgccgcgacgtcggtggcatccaccacgtcgagttccacgccccatggcacgaacactttggacagcaggcgatatgtaccgccgtacacgtcgttgccaatgagaatcgagtcacccgggcgcattgtggcacgcagcagcacatcgatcgccgccagtcccgacgagaagctcattgagaacgccgcgccctccactgcggcaagctgttcgtcgaacgacgtgcgcgtggggttcaccgaccgtgagtagtcgtagccgccgcgcaatccgcccacgccgtcctgcttgaacgtcgaggtcatgtagatgggagtggagacggcgccggtgagcgcgtccggttcctgcccggcatggattgcgcgggtcgcgatgccgtcgtgagcgtagttggtgtctgccctggtcatgatatgcctgttctcgaaaagtatgtctgtgttgattgtgcttggttgattgtgcttgctgtgttcgtgtgtgcgatcatacctcgagcagcacgccgtcgacgagcgatggccggctggtgcgtgccacgatgtcggcgtacccgtgttcgatcatccaatcgtcattgaaaatcttctccaagtacccgcggccggaatccggcagcagcacgaccacggtcgcggactcgtcaaggtcgtgctcccgggcataccggacggccgccgccaccgccataccgctcgaaccgcccacaagaagcccttcctcggcagccagacgccgcgtcatcaggaatgcctcgccgtcggtgacctgctcgaccgcatcggggatcgtctggtcaaaggcgcttgggtagaagtcctcgcccacgccctcgatgtcgtacccatgcacattggctgggctcgagtagatggagccctcgggatcggcgcctatcaccgtgaccgcgccattcgagacttccttgagataacggccggttcccgagatggtgccgcccgtgccaatgcctgccacgaagtgggtgacaccgccctcgcttgcctcccagatctcgggtccggtggtttcgtaatgcgagcgcggaccgttgagattgctgtactggttcggtttgaacgcgccgggaatctcgcgggcgagcctgtcggagacgctgtagtacgaacgtgggtcgtcgggctcgacgtcggtcggcgtcaccaccacttcggcaccgtatgcgcgcagcaccgcgcgtttcgtctcgctcaccttgtcgggcagcacgaacacggtgcgatacccgcgctgctgtgcgacgagcgcgagtcccacgccggtgttgcccgacgtcggttccacgatcacgccgcccggcctgagcttgccctcacgttcggcggcgccgatgatgcgctcagcgatgcggtctttcgacgaaccgcccggattgaagtactccaccttcacggcgatcttcgctcgcacgccatcggtgacgttgtggagttcgacgagcggggtgtttccgatgagttctgcaacagtggtgtgaatagccataatgagtccttagaatcctgatatgcgtgattgtttatgtatattttcagatttcaaacacgccgcaggtttgcgtcgtcactgactgcagtacagctgatctcgattgccgttcatcgaccatgcagtggattcgcccgcagattttccagtactgccaagcgttttcgatgttggaatgtgtgcatgaagtgcacaggtgaaatcgatctcaagttatgcgtcggtaaccgcgcgcctgtggcgttcggtcagcgacaacgacaacatgagaaattcgtcatattttcaagaaacaccatggcgtagacaaacttcataattcggctcacggcgttccgtaatgtggacgcatggtctgccatcatggcgaatggcggggcgctcacgaggcattgtcgaagattcgaatgacctccatgaaccgtttgccgtagcgttcgagcttgttggcgcccacgccgttgacctcgaggaactccttcgacgtgtgtgggtgccgttcggccatgtcgcgcagtgcgcgatccgagaaaacaatgtagggcggtttgcctatctcgcgtgcgatctgcatgcgcagggcacgcaagtgctcgaacagttccgcgtccacgccggtgttggcgcccaatcctgcggcggcacgttcgccggcgctcagtttcgtggacttcgcgtctccgccgctgcttcgtgacttcgacttgcgctccgatttcttgatctcgtatcggaacgtgggtgccactgtttcggcggctcgggggccgaactgcacgagtggcagccgcccttcactcactacgaggaagccgtcggccaccatctggttgagcacgtcgcgaatcttggcttcgttcacttcgctcaggcggccgtacgtgggcgccgcatccaatccgcgattggcgagatcctgcgctttggagccgcgcagcacctgcacgaccttgcccatgccgtagtgctggcccagatcgtgcacgcacatgctgatcgcgcgtgcgactgcggagacgtccaccgtttcgaaggtgctttcgcagttgacgcatccgcctatgcaatggccgtccgccgagcgttcggttccgttcgattccccgaaataccgtgtcatgtagtcgtgcaggcagtccgtggttctgcagtagccgatcatggcatcgagcagttgccgtttcgagcgccgcaccacctcctgctcctcgggggtgagccgctcgttgcgatccgccatgtcgagcaggcgacgccgtgtcacaatgtccgactcgttccacagcaacgtgcatcggctcggttcgccgtcgcgccccgcgcgcccggcctcctggtagtacgcctctatgctctcgggcatgttgtggtggatcacatagcgaacgttcgatttgtcgatgcccatgccgaacgcgttcgtcgcaacgacgagcggcaccgtgtcggtgacgaaatcacgttgcgcgcgctcgcgaacattcgccggcatgccgccgtggtatgccgcggcgatgggtccgtcttccatctgggagccctgtgccttgcgtaactgcggcaccatgatgttgagtgtctgcgcgagcgcctccgtctccttgcgggtcgcgcaatacacaatgccggattcgtcggcatgctcggccacgtagtgcgctatccagttcgccttttcgcgcgtgttgagcttgagcatgtcgaaatacagattcgttctatcgaatcccgtcaccatgacgagcgggttgcgcaatcccagcagattgacgatgtcccggcgcacgcgttcggtcgccgtcgccgtgaacgcggccaccgtggggcggtctggcagcgagtcgatgaactcgccgatcgccaggtacgacgagcggaaatcctgaccccactgcgacacgcaatgcgcctcgtcgacggcgaacagcgcgatatcggcatgtgtggcgaatgcgcggaaccgagccgtctccaaccgctctggagcgacgtacagcagcttcaccttaccggcattggcggcgtcgaacacctgctgttgctcgtcaggggtctgcgtggtgttgatgaatgcggccggtatgccgatctcgttcgcaccgtccacctggtcgcgcatcagcgagatcagcggggagatcacaatggtgatgccatgcagcagcagcgagggaatctggtagcagaccgatttgccggagcccgtgggcatcacgccgagcacgtcgcgtccttcgagaatggcgttgatgagctccgcctggccggggcggaagctctcatagccgaagtacttgcgcaatgtggcgagtgcggagttctcttcacgctcgttcgtcatagtgttccagtgtaatcagtgggcgcgtggagcatggcgacactccagaatgacattctcgctagggagtgaacaaatctgcgttagagagtgaacgttgcagattgtctcaacatgttaatccttgaaattccagcgttttctagactacgtaccaggcacctgttcaccccataatgcggatctgctcactccatagcgcaggaaatcctactgtgaacgatgtggataactcatttccacatatccacaatgcccggttgagattgtgcccgaatctgcgcgaccatagggtcgaaatatgagtttcgaagagagtgattcgcttacgcgattgcgtgaggcgagcgaagaggcggcgcgtgagtgcaggaggtttcgtgctgaacataggttcggtttggtctatgtgtttggcatgaccagagcattgcggttggcgggggtggagattccgcggattgatttgagtgcgcatccgcgcctcagcgagcaacgcatgcagctggtggtgcgaaacaagaatctggaaccacgtgtgcgagctcaggacgccaatcacatgctggcggtgtacgtgtgggatgctccgatggatttcgcatgtctcggcgatgacctcatattcacatcgccgatttgcacatgggcgatgctggctcggttcttgagtctggaggaactcatcgttcttggcgactccatactgcggcgcaacactgtgcatcggcaatactcacaggcggatttcaagaactatctcatagcgcttcgtgcggtgaaggggcgccgtgctcctcgcggcatcgtgaaatgcgaacgtgcgctcacgctgatgagaccgggcacagactcgagtcgggagactaaattgaggttatgcattgtgcagcacggtttgcccatgcctatgattaatcaccggattcgtgccatcaacggtaatgtctattacctcgacctggcttatcctgacgccaaaatcgcgattgagtacgacggcatgttccattcggggcaatggctgcacgacagtgaccggcgaaacgcaatcgaggcatccggctgggtgttcatacaggtgacgaagacctcattaagcgaccattctcaccgacttatgctcgttcggcgaattgcccacgagttggagatgcgcactggcatccactattttgttgacgcgcagactccgctcgctgagttagttaagagacgttagctatggcgtgaacaaagtttcgttatggagtgaacgtctcttgtgactgtatgtcagaaaacggcgattttccaacgtttcatagatttccagattcgtttatgttcactccgtagcgcagaattgttcactccataacgaaaagaattgttcactccataacgaaactcggttaagcgatgagcgtctcccactgctcgcgtgtcattcgattcacatgttcggtgcgcgtttcgccaagcagcggcaccggcacgttctgtgtgacgcgtatgggttcgaaaccgatcttctcctgagtgcgcgccgatttcgtgttgccctcgtaatacgcgcaccagattgcgctgagtcccagattttcgaagccgcggcgcaacagttcgcgggccgcttcgggaatgtaaccgttgccccagaacggttcgccaatccagaatcccatttctgcctgcgtcgtgtcgtttgccgggaagaaatcggagttgccggcgagcttgagggagattgctccgattgcggtgtccggatcgtcggcgagtgcgattgcatagtcctccgggccatcgaacacattgcggatcacgtcaaggctttcctcgatgctctggtgaggcggccagccggcgatggggccgatgtttgggttcttcgcgtattcgtacagtgtcgccgcgtccgattcccgccatggccgcaatacgagacgttcggtgtgcagtgtgggcatggtgttcctttctggttgcgtattgcttgccagcgtaccgcatggccgattctctatgccctggcatcccagcgcgggcatccgaatagcaagtcttggattggggtggcagagggagaccgcatgccgggatgacgaccgcctcatccgcaaggttgagaaggagccttggcggcgtggagattcattccccggcctgatgggatgcgccgggttttcttcgtatcttggaaccatcacaacaagggcggcgagaccgccacggatgaaaggaaatacgatgcgcagcattctgaacatgattctcggactcgacaacacgatgagcggcgtgccggtgacgacgatgaactcggcggtcacgctctcactgatgaacgacggcgcggacgcacgcgtcaacaactaggttgccgctcgaattcgggcggcaacccgaacaacaaccagccgtcggggaagacggcgcacggcaaggcaatgaagcctggcatccaaatgattgttcgcaatgcgtcacgtgacgcacacgcggctcatctacatgcgcgggtggcggatgagatggaagatcagcattccaacgaaccataggagagtcgggacaagcacgtccaacacgccccggacggtggtaagtgaatgccagccattctggaagccggtgagcactaccgtgattacggcgaacacaacggtgccaagggccattcgcagcacttcacgtgaatctggttcgcgcatggttgacaagggtactcccttcgcctactcaatgacgtcccggcgtgccatctcgcgtttccaacggcggatcttcatgcggaacgacgtgaatggcgccaccgtgttgacgtggatccacttccacaccggccacgcggaaggggtggaggaagcccactgacggtgtcccggctcgaacagttcctcttgggagaacgccgtaatcatccagcacaggtagctgatctgctcgttgaaggtctcgatcatctggtcgggagtggtgtcgcgctaggtttcgtagaacatctcatacagctcacctaatcggttccacgaatactcgggggcgggcatgtgcatcacgtggccttcctgctcggcatgctcccaatccagcagcagacctatccagccaagttggtaggcgagcatctgccgcctttcttcatgattgcatcgaccaggtcggttccggattcatatgtcgccatgatgttccttcctctattctgtgttcgatgtggtgtcccgcgtcgtggattctacggattgcatggattgccgagcggcttcacggagttcgcgaatggcgaggtgcttgcgcaaagccactgccatgtcgaggtacgggtcgccgctgcgggattgtggctgtgcagagtgccatgcgttgtgctgatgcgcgggacgtcatacttgctgttcgcggcggcagtagtggtgccggtgtattgcctggtgttctggctgttgacgggttcctaccacccgtccaccattgcggccttcctgctggtcgaatggctgtgtgtgggagtcggtgtgtatatgctgcgatctgtgagaagcctcgacgattacgcgaagtgatacggtgggcgaacatcggggccacattgccatgttcgatggacttgcggcggcggaggatccgtctgccacactcgataatacagtatgagatgcagagccttttgcaatccactggacaatgaggtacgaggagacccaatgacgcagggcatggaaaaccgaacaatggcacagtgcgagggcgccgatgacaaatgcaacatctgcccggtcaggtcgtgggtacagcagcataggacgctgctcatcgtgtgtttcggcgtactgggagtgctactgctgcttatgctcggcagccgtaagaccgtgctcaacatcgcgaatcagccctcgcaggctggcggcaacgcggcgaaggtgatggtcatcgataatcatgggttctcgatgttccagtggctcaccatcggcaatggttcgaacaaccgcccgacgaacagcggcaatacatcgaactgcgcaaatgcgaagcgtgactaagacggcgacggtatcatttgtgcttaggcattgcgcgcgaggaggctcgcgatgcgctgtgccagcatttccggtgtcatgagcgcgtacaggtctgccgagagttcgtcgatgatcgatggcgcaagcgcatctgttaacgccttctcattcccgttgaaatgtcggaatagcgcatggaagagaagtgaatcatggcgtatccgtgtgactgaatacgcgccatcctccaaagcccatgccaccttcgtgtgctcgtcgtcatccagtttctctttgttcggatacagtttgcgttccatgagttcgtagagcacgtcgagcagatcgatccggtcggtggccgagccttcatcgagggtgtgcgcaatgagctgtgggtcgacctgttctaacgattggcgcatattggagttgggtatttcgtttcggggattgcctcggagattccatgctcacatggtaaagcagatgcctggcaacagagtcgtcttgatttccctgttgcagctccgcaaatccacgttgtatcctggtcccgatagttttccggaatatacaggctatgggggatgcatggaagagccgaaactgattaaagtggtcggagccgccatcatcaaagatggcaaggtgctgtgcgcgcaacgcggcgcaggcaaatctctcgccgggtattgggagtttcccggtggcaagatcgaagcgggcgagacacctcagcaggcgctccagcgggagatcgaggaggagctgctctgcgagattgacatcgacaagaaggtgtgcaccagcgactacctctacgatttcggcaacgtgcaactcaccaccttcctgtgccatctcatcgagggaatgcccagacttacggaacatgagtgcatcgaatgggtggagccttcgcagatgccccgtctgcgctgggcgccagtggatcatgatgccgtgacgcgaatctccggcatggcattctgatgtttccgaataaccccgatcataagcgaatcataagtgacggaacataaatatgagcagccagtttcaagcggacaacaccttcgtcaggcagagccagtctgcaaccgaaccgctggaatctgcggatcacggcatcgtcgatggtgtgctgagcggtttgatccgacagaatgatctggcacaggaacgattcgtgcccaagctcatttcaaatcagccgggaagcacaatgggggatgcgattcgagaggagctaagggaaagcgagacgttcgacatctccgtggcattcgtcagtgagaatgcgctgaaatcgatgtaccaatcgttcctggaccatgcagagaacagcgaaaaaaccaatcggatcatcacctccaccaagaactatttcaatacgcccaaggccttcaaggaactcctgaaactccaacgtgaggccaacgtggaagtgctcatttgggaacaacaaagcactgaaggagtttcagccaatcagccgttccatccgaaagggtaccttttcacacgacgtatggaggagggtgatcgcagctactacaacctgtatgttggtagttcgaatctcacgtcattcgctttgcagaatcaacgtgaatggaatcttcgtgtctcgtcgacgggcgaagcgcaactcattgaacaggtcagggaggagttggcagaccaggtcagtcagtccgtgccgttgaccgatgcatggttggcgcaatacgaggaggaattcaggaactacacgcctccacgcacgcagattctacgacaaacgcgcacggcaaggatcgaaccgaatgcgatgcagcgtgacgcgctcgccaacattcggaaactgcgtgaggagggtgaacggaaagctgtcgtcatttcggcgacaggcacgggcaaaacctacctctccgcctttgatgtacgtcaattccaaccgaaacgcatgctgtacgtggccaatcgcgatacgattctcaagtcggctcgcgaatcgtatcagcgtgtgctcggttgcgacgagggcgaactcggtctgctcaccggtaacagtaagcagcatgacgcaaagtatgtgttcgcgacagtcgacacgttgcgtcgccatatgatggagtggtacgagcccgatgattttgattacatcctcatcgatgaggctcatcattctggtgcaaacaactatcgctcggtcattgactacttctccgaagccgatttcatgctgggcatgacggcgacgccggaacgaactgataatttcgacatcttcaccctgttcgatcacaacatcgcctatgagatccgtttgcagaaggccctcgatgagaatatgctgtgtccgttccattattatggcgtacacgaattcctgggagcagacggcacccgagttgatgcgactgaggggatttcgaaaaaagacaagcagcagatccagtattcactcgaagaactgaccgagccttcacgcgtgcagtacatcattcgtaaactcgaacaatacggctcgtacgaccaacctgtgacgggactggtgttctgctccggggtggaggaggcagaacgactctcggaactgttcaatcagcagaccaaccagcaggcggaacgcaattacagaactgtcgccatcagcggcaaaaccgcagggagagatgtggaaggagccattgatcggcttgaatccggtgatcttgattacatctttaccgttgataaattcaatgaaggtgtcgatatccctgccatcaatcagatcgtgatgttgcgcaacaccgagtccagcatcgtgttcacgcagcagttgggacgaggattgcgcaagttcccgcacaagacctgcgttaccgtcatcgatttcattggtaactacgagaacaactatctcattccggttgcgttgtacggcaatgctggcgatagcgatagcgcgcgcaagaacatgcaacgagaatcgatcggcctgtcgtcgatcagtttcgatgagatatcacgcaagcaggtgctcaaatcgttggatacggcttcgtggtccgatatgaggatgttgcgcgacaagtattcggtgattcgcaacgagcttggtcggattccgatgctgacggatatctatcgccatgatccatccttggtgatgacaatggcgcagaaagccaacagttattatgacttcgcgcgtgacacggaagccatgctatcgcgcaaaggtcatgatgaaggattcgcggatgcgcttgtgccgatcgatacgcaaggagaacagtggctcaaaatggccaccgaagtgctgttggttgcaatccgtccgcaagagcttgtcatccttgacgaattgatcaagtcatgcgctggtggctctgtctcgctgatcccgacggaacagttgagggaaacagttgcgcgacgattccccgcgtcgtaccacaccgctgcacagttcgaatcggcgctcagcgtgctcgactggtcgttcttcgacgcatccaccaagaaatcgtatggggaacgcgcgctcatcgaacgcatcggagacgggatttgccttgcgccggagttcatcgcgatgctcaagaacaacgccacgttccaccgcttcttcgtggacaatgtgcgcactggcctgaaacgattcgaagaccttctcgaggaagcggcgaaaaccggccattcgttgcaagacgaccgcggattcgtctacgagcatcggtacaagatgttcgaagtggaacgtctgctcgggtggagcaagcagatcaacggcagcagcgtcggtggctatctgctccccaaagacgaaaaaagcatgccagtgttcatcaaatatgcgaacagccagtacgccgaccgtttcctcaatccacaggaaatgcactggtatagcaaagacaggcgtagcaccgcatcccgcgaaatcaaatggatggaagaaggaaagggcaacgaggaatggagtgagaatcatttcatcccgctgttcgtcatgcgtaaggcggacgccgagaagctgaagatgtactattacgtgggtcgtgtggggtcatattcgaatctgcacgagacgaagcgtgacaatgacggcgagagtattggtcttgtggagatggatctgcggctgaccaagcctttgagcacggaactgtatcagcatctgacaggggatgcgtagcgcgatatgcgctcggtcagcggaatgcgcacctatcggagggatatgagaccatatcttctcgaacggcaacaagcgcacggcgaggaagagggcgctcgcgattcccgtcatgcaagcctggagcgtgcgaatgaaatcggtcttcctggaatctggtgaatactgccatgtgtgaggggttttagatcacgccagatgcgtgatctatgcagttgtattgatgactgggcttatcttgcaactatggaaaagcagattgaagcgtggaaagaattgcggcgtctcgacgcgctaatgcgacgacttgggaatcgatatcctattgttcgagccttctctcgtcttgaatccaaaatctcctgcagtctcgatgggtacgatgcttcacttgaagatgttctttcctatccagagcgctacatcatcgagcgtcgtagaaccgtgggttctgaacgtgcgatattgaactatttgtatacgttgggatacggtaccgtgatggttcgcggtgggcagccattggattggaaattcgttcgtgaattgcatcggcagctttgcgacggattgacggctgccgaaccggtgctggttgcacctagaaatatggcatcgggaacgatggatgacctgttcgcgtggtgggataacaatgatatctccgactcggtgattgatgacatcattcggtttcattaccgttttctagcgctacgcccattcgcacagggcactggcaggatgagtcggttgcttctcttactgcaactcattgccagaggcgtgcttcacgagccgatactcaccatgtcgatatggcttgaaggcaatatcgcggaataccgcacatgtttggatgaggcaatactacgtgggaacgagcagccactgctgatgttcttccatgacggctttagcgattgtgccggcgccgcgtgtaacagcgtcgtcagtcattctgactcctaccgtatgtaggttccggcttctaccgtagtaagtattgcattttgcgagatcctgaatttggcctcctctacttgtgtaagagggaaaagaatataggaagctgagcgccgaatttcggtaaaacggactaaatagtcgacgctgccatcgcgaatgacgataatgcgttatacattccatgcggtgcgagcgaatcattgtttggatattggtaattacttagaggtaagaacgaagcggatgagatgccacatgatgcatcgcggctagagatgctctggcatggcaagagtgatcgtatctctaagtcacctgagttctccaagtttttatgataccggttttgataatttcttgatttattttgccgcaggtcacaatgggccagatgaattgatctgaagatccagatcatttacaatgcagtcaggtcaacagcggatgcggaaggtgtgcattatgcagatcatggctgagacgaagtcgttggaagaattgatgccgatgcgaggcaataacgcctacatcattcctgaatatcagcgatattattcgtggggggaggaacagatcgaacaactgttcaacgatattcagcaggaggatcctggatattatgtcggcaatctcctcgtcacaaaccaccgggattccgaatcaactgtagatgtcatcgatggtcagcagcgactcatcacgctgtcattgttcctcttggcagtatgggagcatgcgacgaaattcatggatgaaccgcagaaagactctggcaaatatatcagtgaggaacaggaggaactcattggccttcgtcgcgatatcaagcgccagctgctcctcgaagagaaatccagaatgccacgccttcaattgttggaaccggatagcaatggatatcaggcgctccttggggtggtgttcggtgagcggccggtcaagatctggcatcgcactttgccgaaacggtacaaatatatttcgcaaaagctgttcgctgatgagtttcgcacgcctgaagaattgcagagtttctacaataagctcaattcaatcatcacattgcgagtcaaagtcactggccttgaggatgcactcactgtattctcgtcgttcaactcgaaaggcaagccgctgacgctccttgatctcctcaaagttgagttcatcagggcgggcaacgagtatctccatcaagacagcgacgaagtgctcaggtcatgggaccgtttaatgagtgagttcagcgatcagcaaggcaataccaacgatgctgctgtcacccagttccttcttaacaactacgatgcgttcgagaacgacagccgctcttccgttaccaaaggcaaagcgctgcgatattaccagagactcattgatggtaaatataaaaaaggggaggactatctgcgcacgatggtccgtcgcgcgcagacattcgcgcagatcgttatgccggagagagctgcatcggagcatcgggagatcacagaacgtctcagcaaacttggcaagcttgagtcaacccagctctacccgttgctgttctttctgctggagaaccgtagctggctggatctggacgctaaacggttgagcacattgttggatgcgatggtcgcgttctacgtgcgccgaaatatcacgctggtaccgaaatcgtcgaatattcgtgcgatgatgctcgattacattcgtgagatccagtcgaaaaagcttaagggcgatgatgtagtgcggtgcattgtcggcaaattgggcgcgctcccgcagatcaatgacgatgccgttcgcagtgcactgctcgagtccggcatgtatgacaagaacaagaacaccacgcgctttctactcatcgagcttgaacgccgactgcctggcagtgacctattcaacaaggcgacacctgataacctcgatgagtacgacaataagacgccgcgctggacgatcgagcacatcttgcctgagggtgccaatctgccggagtggtggaaggaggcgatttcgccggatgacccgtcgaacgccggagaaatacaggaacaggttgtgcatatgctcggtaaccttacgctaactccgtataactccaacctaaagcagctgccgttcgccgcggatccgccgtatcaggagggagaggcgaattatgtgaggtcgaagcgggactaccggcgcgacggtcagttcgttggtctgcgtgagaacttaaaactcaacagttcgcttactgaaccgagacagccgatcgatgagaagcgtgattggacggcggcagatatcaagcgtcgtaccgccgaactcgccgatgccattgtcgaactgttcgatttcccggaggtggaggctcccggtgacagtgccgtagaaagtcatctaagcaaggtgacggatcccaaggcttcctgacttttccgcagctgaattccaccagtcgactgtgtgagacaaatgcaggtgctgtgcaaaaagtgacatagactgcaatgtttttggacttggcacggttcctcattgccgtgcatgaagaatgtccacaaggtgaatcagtcgcgacgaattcagtggtgaataggtggttgcgggagtataagctgctatttgtctatagtggaggtgtcgaacatagcgaacctggaggtgggcaatgctggcgtcggatgtcgcacggcacatcgtggcgcactatggcgacgcgtggttcctcacgaatctgaagctgaacctgctcgtctactggtgtcaggtcggggcattgcgcgacgccggtgcgcctttgttcgccgatgagatcgcggtcggcgaatgcgggccggtcatacctgcgatctgggcggaatacgaggcgttcggctcgcgcatgatccgcctgcgcgacgaatggcaagtcaaagcgctgggggagaacaccgagagcctcgtcgcgagcgtgatgcgtgagctcggttggctgacggcggccgatctgctgaatctgtcaaaccatccggatggggcgtggaatgcggcgcgtgagcaaggctatgagagcatttccgtgtcgcatatcgccggctctgccgacatgcgacgcgaagtgagtgagcgcacgctggccgcctgtgtggacggggtggagcgcaaatacccgaatgcgctcagattgctggagcattcgtgatggaaggggagcggaagatgggcaatgccgaagacggtgccgaaccgattgcgctcgacggcaagcagatgcgcatggatgcgcttgcggaatcggtgttcgaagtgtatgtggagacgattcgcggcaccggactcgacatcacgccgacggcgcccgctgcggtggatgagcgaatcctcggacgtgtgcagtcggtgctcggctctacgttcctgacgttcttcggcataacgccgcgcgaacgatatgccgacgtgttcgagcagatctccgatttcgcgtcgcgtttcgcgaaagaccatattttcccggacggcaacaagcgcacggcggtgaagatggcgctcgcgatcctcgcgatgcatggctggaacgtgcgcgcagacgatgccgaggagccggaacgcaacgagctgtaccagtgggtgcagagcatcgtcaccggccgttgcgatgccggggagctcgccgccttcctgcgcgggcacgcggtgcgtttggaagattagagaatctgctccatgccgtatctgtacacgctcatgccgagtgactcgtagaacttgacggcggctggattcgcagcccaggcgttgagcgtcacattgtggtagccgtgtgcacgggcatagtcgagcacatggtcgtacagctcagtgcccacgtgtttgccgcgcgcacgctcgtccacgcagatgtcgtcgatgtacagcgtgcgaaccggctgcagattgttggcgcccgcatggttctcatccatgcagaacgcgtagccgagcaacgtgctatcggtgtcggttgcgacgaaaatcgggcgggaatcgtctgcgatgatctgtgcgagttcggtgggcgtgtatttcgtcttgccctcgatgaacaggtcggggcgaccgtgtgcatgcacgtcgttgacctgacgcaacagttccatgatggcatcgatgtcgccggcgttggcatgacggatggtgaggttcgacatgattccctcgtgtttctgcagggttgctttcggttattcagtgtagattccggtgtggccgccaactcagccgatgagccactttgcattgctcaagctatgcagcgggatgaacgggatgagaatcggtgtgtgttcggaatagtgccggtattgcgggtcgtctgcatattccttgttctgccgcagctcgagtctgcgcgcgccgccgaacatgatccagcagatgcacaagtagccgccgattgcggcgatccattgccaggcgccgtcgagtatcgtgacgccggagacgaacacgcccgtccaggtgacgatctcgccgaggtaattcgggcagcgcaccatgcggaagagcccgacatcgcagaagcggtgtgggtgttgctgcttgaaccggttcttcgtgagatccgcggcggattcgagtatgatgccaacgcccatgatcgccgcgcccacaatggcgacggcgtcggttcccgcatggttctgcaagcggaaggcaattggcgaggcctcgcatgcgtagaggagcgcgcagccgacccatgtgagaagcctgagcgggagcttgacattgttcccgttgtcgattgcctgttgcatcaccttgtggtaggaggagctgcggtattcgcgtgcgagcagatagccgccgagccgtagtccgtacacgaccagcaatgcggccatgatggcggtcacggccgtcagctcatgccgcacgccgaacatgatgagcagcgcggtgccaatggccgcgatggagaagccgtagcctatcgagatgaaccagatgtagcggtgaaaacccactgcgctgaccgccagtgccacgaggaagataatcaagaatgtcatacttcaagcatattcgctcggtttgggatgtcgcgggtttatggcgaatagagccgtgggcgcatttcgccgtttcgggtggaatgcgcccacgcagggtgtatggatcagaatgcttcgacggtgcgcatcgcatcgatgatctggtcggcggtcacgtcggggacggccgcgtggaacggggagcctggatctgcggcgaaatcggccaccgtcttgagattctcgtcggtgaatggcaggttcatctgcttccaggagtggggaagcccgatcttgttgtagaagggcagtagatcgcgcgcctcgtcttccttgccttcggtgatgagctgcacgagcacgccgtaggccactttctcgccatgcatcgtctccgcggagccggggatgcgggtcagcccgtcgtgcacggtgtgggcgccggattcgcgggcccgcacgccgccgaagccgcctacggtgccggcgatgccgatgatcgtgtcgatcagtgtgcgtacatgcgggtcgtcgtatgcgccttggttcaacgcgtcaagcgcaggctcgctttcgctcagcagtgtgtcgcgcacaagacgcgcgctctgccgcgacaactggtcgaatacggtcaggtcgtcagcttgggcgaacacagggtcggactcgtagaatttcgcaatcgtgtcgccaatgccgccaatgaatttctccggaggcgtctgggcgatcatggctgaatcgacgagcaatgcgacgctgttcctcgggtgcacgggcacgccgaggaagcggtgttcgtcgtcatagtccaccgagtatggcgagtaggcggcgcaggcgcaggccagcgtggggacgatgatcaggtcgacgtccatcatctcggccacgttctttgcagtgtccgacagtttgccggcgccgatggcaatgattgcgtccgcgtcgagcgccttcgcctgttcggcgagttcgcgtgcgttgcgttcgctcgacgaaccgtcgtagcgcagaacgggtgcgaagaactcgtcttctcccgtatagtcgaggaacgcgtcggcggatttgacgccggtgatgatgacggggtggtcatagtcctcgatgtacttgcggacctctttggccactcccggtgtgctgatgtaacggttgggacgggacggacgtcggaatcctgaacattggttgccatgggtgtgctgttctttgcgagatgaaacggatatgtataggtggcatgccgcggcagagcggcagtggtctggattcacaggctcatccgtgctatctgcggtcacgcgcatgtgccccgcggtgaagagcttgtggcaaccgcggtgtgttgaggacaatagtaggcaatctgttgaccaggtcagcctgaagtgaataattagataaacaaaaaaagattgcctagtaaagatgtgcgggcaagtgctggaagcgacggcgggtgccggcgctacactgagtgggacgcactgttacaacggaaagggcggtcatggcagacgaaccgaatacgcagagcaagccggtggtcgaaagcttccagctcgaccatacgaaggtgaaggcgccgtatgtgcgctacatcgatacggagaccggcccgaacggcgatgtgatctcgaactacgacctgcgcttggtgcagccgaacgagaacgcgattccgacgggtgggctgcatacgattgaacatacgattgcagtgctgctgcgcgagcgcattcccggctacatcgactgctccccattcggctgccgcaccggattccatctgctcacgtggggggagcattccaccgaggacgtcgccaaggcgctcaaggaatcgctcgagttcatcgcgaacgaagccacgtgggacgacgttcccgccacaaccatcgaaagctgcggcaactaccgcgaccacagcctgttcacggcgaaggaatgggcgaaggacattctggcccaaggcatcagctccgatccgttcgagcgcaaggtggtctgagtcttcccgggaatgttcatatgcgccgtcatatagcaggcggcgcatatattgtgtgagccggaatgccatacaggctgtgcaggaattcgcgaatgagaggagaaacggtatgcaggacgccacgaacaggcgttttcgccacgcgaccatgaaggactaccctcagatggagcgcatctacgcgcatgcccgcgaactcatggcgcgcaatgggaatccgacgcagtgggggaacgcgttcccgaagccgcagacggtgaaggaagacattcgcgagcaccgggcgatcctgctggcagatactttgggcggcaaggaacgcattctcgcacagttcgcgctgtgcccggggctggacccgacctatgcgaagatcgaaggtgcgtggctcgacaacgactcctatgtgacgatccatcgcatcgcctcgtcgggcctggtgcgccatgctgcacgcgactgcatcgaatggtgcctcaaacactatggcaatgtgcgcgtggacacacaccccaacaacaaggccatgcagcatgtgctcgaaagctgcggattcgcccgttgcggcctgatccagctcatcgaccgcaccgaagacacgacgcgcatcgcctaccaacgccacgagtggtgagccaatgggcccgtggggtgcgagtccacgtcccacgcatacccgcttacgcactcgtcatacgaacaggccacaatggtgtgcatgagcgtgagtgcacttgaagaatggcagttttcctccgaacagggcgagcgcaactataatcaggcgctgcgtgaataccctgcgcaggtgatcgtcgatctcgccgcgttgcgagacaacatgcgccacttggtcgatatcaccaatcgcgagggcggtcccaccgaggtgatgggagtggtgaaggccgatgcgtatgggcacggtctggtcccctccgctttggctgcgctcgccggcggcgccacgtggctcggcgtggcgcaggcccgcgaggcgctcgcattgcgcaatgccggcattggcgttgatcgggcccgcgtgctcacgtgggtgaacaatccgctgcatgctccctacgatgacctcattgcagccgatgtggacctttcggtggccaccctgactgcgattcagaagattgctgaggccgcgcgagccgttggcaagccagcgcgcgtgcacatcaaggtggacaccggcttcgggcgcaacgggttcacattggcccagatcgactccgccatcgacttgctgctgccgctggtcgacgaaggggtgtttgagatcgtgggccaatggagccatctggcggtggcggatgcccctgccgtcggcgagttcgttgagaaaaccgacgaacagattcgggtattcgaggagttcacctcgcgcctgcatgcacgcgggatcgaaccgcgaatccggcatctcgccaacacggctgccacactgagccgccccgagatccattacgacctggtgcgaccgggcgtagcgttgtatggctatgaggcggatccggcaatgggcacgccgtcgaagtacgagctcaggccggcgatgacgttgcaggcgcaactgagctccgtgaagaacgtgggcgccggtgaggggctgtcctatgggcgcgtgtatgtgaccgatgagcccacgagcgcggcgattgtgccggtgggctatgcggatggcattcaccgttccgcctcgggatttaacgaggccggttcgaagcacgtgaacaagccgggcgcgccggtgcgggtgatgacgcgcgatggtgcgcgcatattccatgtgagcggccgcgtatgcatggaccagttcatacttgacctgcatggcgacgccgagaacatgggtgtgcatataggcgatacggtggagctgttcgggccagggcgcggcgaggactatcttgagccgaccgccgacgactgggcgcgggcggccgatacgatcagctatgagatcttcacctgtttgcgcaaccgtgtgccgcgattgtatgcgaatgcgttcgaagtgctcgacgagacggacctgggcaagctcgaccagagcacgctgctgtgatgtgcccgtacaccgccattgcatgaatcgccgcgaaggcgcgcagattctgcggaaaatacgccgatgacgctggggaatccttcgcctgcctgatatgctatgccacatggccgggatgattaagaaggaagacattgagcgcgtacgcaacgcggcggatctgtacgacatcgtctccgccacggtggcgctcaagccctcgggtgtgggcgcctatgtgggcctgtgcccgttccacgacgagcgcacgccgagcttcaacgtccgtccgtcggtcggctcatggcattgcttcggctgcggtcgtggcggtgatgtgttcaggttcgtgcaggagcaggagaacatagacttccgcgaggcggtggaactgcttgccgacaagtaccatatcgagctgcattacgagaacgccggcggtgcgaacgactcgcataggggcaccaagcgcgcacgtcttcttgaggcgaacgaggaggcccagaagttcttcgtgagccagattctcaccgaggaggcgctgcccgcccgcaagctgctcgccggccgcaatttctcgcagcaggactgcgcgcggttcggctgtgggtatgcgccgcagggctgggacaacctggtgcgtcatctggccgacaagggcttcacccagcaggagatgctcgacgccgggctcgcgcgccaaggagcccggggcatatacgattacttccgcggacgagccacatggcccattcgcgactcgacgggccgtaccctcgggttcggcgcccgcaagctctacgacgacgattcgatcgccgcgaaatacatcaacacgcccgacacccagctctaccacaagaaccaggtgctctacggcatcgacctggccaagccgcagatcgtgaagaaacgtcaggtcgtgatcgtcgaagggtacaccgatgtgatggcgatgcatctggcaggcgtggacaccgccgtggccacctgcggcaccgccttcggcgaggagcatgcgaagatcgtgcgccgtctcatctccgacgattcgcttggcggcgtgcagctcaccggtccgctcagggtggaaggcgaaccgctgagctcgcgcatcgtattcaccttcgacggcgacgcggccggccaaaaggcagcattacacgccttcggccttgattcctcgttccagacacagaccttcgtggccgtggcagacaacaacctcgacccctgcgacctgcgcatcgagcgcggcgacgacgccttgcgcgccctcgtggtcaacgcccggccgttgtacgacttcgtgatcgacgtagccataggcaagttcgacacccaatacggcaccggccagatgggtgccgtcaaggcggtggcgcccctgatcgcgcgcatcaaagacaagagcctgctcgacctctacacgcgcaaggccgcccgcaggatcggcatcgatctgacgatcctgcagcgtgaggtgcaatccgcacgacgtgcgcagcatgtgccgaatgaggacgcctatgcgtcacgccaacgcggttacgaccgcaactatgaacgcgaacgtgaacagcccccaatgaacgaggcgcgtatgcgtgaaatcgagcgtggcaatgcgagatcccagcatttccaccgcatcgacgacaacgtgttcatcaccgagatgcagttcatggccacgctggtgcagattccgcgcgccgtcaacgccgagctgttcaaggccctcaccgtgcattgcttctccacgccggtgttccagacgatgttcgaggcggtggaggccgccggtggccttccggaacccggcacgtcgcccgggcagtggctccatgcgctcaccaaggcgggaggcccgctgctggcaccggtcatcaccgagctggccgtgatgaatctgccattgccccagaacatggcgaacggcaatgcggcccagacaggccaacaggagccgggcagccagtccgcccagccgatgcccgaggcaagcgcggagcagaggcaatatgccaaccagctcaccgccagtctcatcgacacaggttacatgcgaagaatcggcatcctgcgccagcaggcgagtcgtgcgacgaacacgcatgaccagatccggttgttcggcgcgatcaccgaggtcgagcgcgagcgcaaggacctgcagtcgcagatcttcggctccgcggccggctgagtcgatgcatcggaccgagccggtgccggccatgaccgttttgactctgtggaaaacttttttgggcaaaacggtcggcaacgaacggcaatgtttgcaagtgcaaatggcgtcatccacacgtatttggtcgggaaaaccgtgcacgaaatcccatgtggcaccggtatttcgtgtaggatagtaacgttttcgacagagtgtggaggagtgaatgcgacatcgtgtgggtgcattcctgcgtggcgaaaccattctcatagtggctacgctgctcgcattgatttcctgtttcattgttcccccagactggcactatcgcgaatacgtgcatgtgagcaccattgcgcagctgatctgcctcatgctcgtcgtatgcgggctgcagcgcgtgggcgtgttccgcatcatcggcgcgaagctgctcgaacacgtggataccgcacgcggactcgtgctcacgttcatctcgctcacgttcttctcgtccatgctcatcacgaacgatgtcgcattgctcacattcgtgccgttcgcactcgccgtgctcaagatggcgaagatggaggaccgcgcgattctcgtgtgcacattgatgacgatcggggcgaacacgggcagcatgctcacgccgatcggcaatgcccacaacctctacttcaaggcgctcaccggcatgtccaccgggcatttcctggcggtgatggggccctatacggcggtctcggcggcgatgctcattgccatcacctgcattgtgttccgcgggcgcaggctcgagggcatcagcggcatggactccaaatcgatcgagcatggcgtgcttgcgccggattccacgaaaccgcagcccgacgagatccacgttaccggctatggcgccggttatggcggctggcgtgtgattgtctacgccatcacgttcatcgtctgcgtgctcgccgtgggcgacctcattccgctctgggtcatgtgcgtggtcgtgttcgccgtcatgatggtgtgcgaccgccgctcgttccgccacgcggactggggcctgccgctcacgttcatcatgttcttcattttcatcggcaacatgaggcgtgtgcccgaattcgcccagctcgcgcaacagtgcgtgggcgtgcacccgctcggcgtctcgatcctgttcagccaggtgatctccaacgtgccgacctcgctgctgctcgccggcttctcgaacgcctacgtgccactcatcatcggcacgaacctcggcggcttgggcacgctcatcgcctcgatggcttcgctcgtcacctacaagcacttcacgaagatgtatcccaaccaaaaaggcaagtacctcaaggagtacacgagcttctgtgcgctgttcgtacttgtgctgttcggtctgagctgcattctcgaatagtatgcggatggtggcgtgatgatggtgctgttgcgaaacgggaggtcggagtgctgtgcggcatgctcgtggcggtgggcggcaacttcgcgatgctcgccgccaagcagattcgccgccgtgcctagagcgaccggcgtgcgctgtgcagccctatggctatactaggtacggtttggccccgtagctcagctggatagagcatgtgacttctaatctcaaggtcgacggttcgagcccgtccggggtcacttcaagcgaggattccatggaatcctcgcattttcgtatgtatggggcgttagtcgagcagtccgtggatgcgcgagcagatcgactcgacggtcatgccatagcggctgttgagctcggcgagcggcgtgcggtcggtgaactccttgtcggcgccgaaattgagcacgcgcatggtgcaatccggcatcatgttcgcgtagaacgccgtgatcttctcaccccagccaccctcgagctggccgtcttcgagcgtgaccaccacgcggtgatcctcggcgagcgagcgcagcgtctgctcgtcaagcgatgagaactgcaacgggttgatcagcgtggcggcgatggcaggggaggagtctgcaagccgttcgaccacggcatgtgcggtcgcgaacgcattgcccaggccgagcacggcgacgtcggtgccgtccgagaccacgtcatagccgaaccagggtttgagcagatcggtcttctgcggggcgagcgatgcctccgggtcgagttcgccggcacgctcatccttgagaatcgtgtcgcccggcacgcggatcaccaccggatgcgtgttgcgtgctgacgtcgaccagccgagcatgtcgaggaacatgcggcgcgaagtgggagccaggcaggtcagccccggaatgttgccgaacatcgcgatgtcgaaggcgcccgaatgcgtgttgtcggcgtcggagagacccgcgccgaaggaaaggagcgtcaccggggtgtcgttgagggcgagctcctgctgcaattggtcgaaggtgcgctggaagaacgtggcggaggtggccacgacgggtctgccaccggccttggcgatgccagaggcaaaagccacggcatgttcctcggtgatgccggtatccacataatgtgcgccggcgcgctcacggaagtcctgcgtgatgccgttggaaccgggcgtggcaggcgagatgaccaccagccccggttcggtggcgaaacggcgttccagcgacgccatggcaagaccgccatagtatttgcgggcgccaagcgaagaatctgcccgtgagagcggattctgccaatggttcgcctcacagcggccttcgcacacgccttgtgcggcatcctcggcgtcgagccccaaccccttcgttgtgtgaatgtgcacgaccaccggatggtcgatgccgtgcacctcctcgaaggcacgaatcagctcatgcacatcgttgccgtgctccacatagcggtagtcgagtccgaagtcgcggaacagattgcgttcgcccctgccgtgcgactcacgcattgcggccagcgtcgcatacatgccaccatggttctcggcaatcgacatctcgttgtcgttgacgagaatgatcatattgccgccttgctcggcggcgttgttgagcccctcaaacgcaatcgccgagctgagggcgccgtcgccgatcaccgcgatcacattgttcgtctgcgccgtgccccccgcagcccgtaccatgtcacgttccttcgccatgccgcatgccagcgagatcgacgtgccggtgtgcccgagcacgaaatggtcgtgctcgctttcccctgggttcgtgaaaccggtcaccgtgccgaacagctcggccctgcggaacgcctcggcgcgccccgtgagcatcttgtgcacgtagctttggtgcgacacgtcgaacacgatcttgtcgagcggcgattcgaacacgacatgcaatgccacgcacgcctcgaccagaccaagattggaaccgatatggccgccgtacctcttgccgtattcgacaagcgtctcacggatctgcgcgcacagggcatcgagctgcgtgggatccagcagcttcacgtcggaaggcgacagcacttgagacagaaggtcgtgtgtcatgagattagtgatccctctctattccgccgggcaggcgttcgcaagaatatgcgggcattccaacattcgcgtcgcatatggtcaacttcatgcacatattatagtgtgagagctataaggcatcaatcatgccagataatgccgcaaaaggagtgctcgcgcaagccgcgacacacctttggcgtacagtgaacaagtcagggtgagccgcgcgcctcccacacggatcgggtgcgggcgcacatgcgctggaggtaatatgaccgcaaacaagccgcaagtggcagtgattatgggctcggcgagcgattgggagaccatgaggtacgcctgtgagatgctcgaccgctttgaggtcccgtacatgaagcaagtggtctccgcacaccgcacccccgaactcatgggtgaattcgcgcacaatgctcgcgccaacgggctcaagatcatcatcgccggtgccggtggagccgcccatctgcccggtatggtggccgcacagaccacattgccggtcatcggtgtgccggtgcgctcccacgcgctctccggctgggattcgctgctctccatcgtgcagatgccgggcggcattccggtggccacgacggccgtgggcaattcgggcgccacgaacgcgggtctgctcgccgtaagcatgctgagcatgaacgacgagcgtctggcggacgcactgcaggcataccgcgacgaactcaaggagaaggtggagcagtccaatgccgagcttatctgacgaaaccggcggccagatcacgcgtctgctgccgggggcgaccatcggcatcgtcggcggaggccagctcggccgcatgatggcgcttgccgcgaaatacatgggcttccgcatcggcacgcttgacccgacacccgattgccccaccgcgcaggttgccgacttccagattgtcgccgactacgacgaccaggatgcgattcacgagctcgccgaacgcagcgacgtgctcacctacgagttcgagaacgtggatgccgacgcattggatgcggtccgcgacattgtggcgattccgcagggcaccgacctgctgcgcgtgacacagaaccgcatcgccgagaagacgttcatcaatgaccatggcatcgccacggcaccatggcgaccggtgggctcacgcgcagagctcgacgcggcgctcgccgagatcggctacccggccgtgctcaagacctgtgaaggcggttatgacggccatgggcagatcgtgttgcgcacaccggacgatctggccgaggtctggcctgatgagggcttcccgcaggcgatactcgaggggttcgtcgatttcgcgttcgaggcctccattctggtgagcggcaacggcgatgattaccagacgtttccgatcgtgcgcaacattcaccgcgacaacatcctgcatctcacgcttgccccggcggacgtggacgaacaggtggcgcgcaccgcgcatgaactggcgctcgagctcgcgcgcggcttcaaattggcgggcacgctcgccatcgaactgttcgtcaaggcggacggcaccgtgatcgtcaacgagctcgcaccgcgcccacacaattccggtcattacacgatcgaagcctgcgatttcgaccaattcgacatgcatgtgctcggcatcgccggctggaatctgcccacaccgcgtctgctcagccccgcggtcatggtgaacgtgctcggccagcatatcgcacccacgcaggccgtggagccgatgcatcccgaatggcatgtgcacgactacggcaaggccgaggccaagttcaaccgcaagatggggcacatcaccgtgctgtgcgagaatccccgggatgcagcgcagtcattggaacagacaggctgctgggattgttgaacagtctggtacagattcacggattcgcaaggtgaggaacatgggcgagcgcaatacacggcagaaggacgtcattcgggaggcgttgcagggtgcggacgacttcatctccgcacagcagctgcatgcgcggctcgaggacgccggcgagcatattgcactcgccaccgtgtaccgccagctggggacgatggccgacgccaagcaggtggacaccgtgcggctcaatgggcagcagctgttcagactgtgcaacgccggcggccatcaccatcacctcatgtgcgtgtcgtgtggcagaacggtggagatcgatcctccgagcgaggcgtggctgcagtccgtggctcagcaacatgacttcaccatcgagtcgcatacgctcgaggtgttcggcctgtgcgcggactgccgtgccgcacgcggtgactgtgcagcctgacacttcacggcagactttagcgccagctcacgcgtgttctgcgtaaaaggggacaaatacatgcatgtatttgtccccttttacgcagaacactgatggtttaccgtggttcgccagcttggtcgtccaccggcttgccacctttggcgtcatgtacctcggactcgtgtgcagcatcgcgtgggctgcctgcaggctgcccatggcccgttgccttcccgtcatccttcggcttggccggtttgaagctcgaaagcatgcccagggcatccctgaacgtcagggcgggcaggtaggcgcggatgattgcaatgcccagattggcaagcaatgcggaatccgagtagctgatgtagaccggacgctcgatcggctggaacttcttcttgaagttgtagagcgacttgaacccataggccggttcgagcagatccgccacaagcgcgagcgaatgctggagcatcgtggtgccatcgacattcgagctgtcgtcgctcttcgcgtcggtgaagttcttgagtcccgtaagcggtgccgccgacaggctcacgaactgcacctggttgctcggatcggccacaccctggtcatgcatgcgctgggccatgcgtgcgatgaggaactccatgatgccgttgtagcttccggaacggtagcgcatgaagtccagcgtccagccgatcacgcgcccgttgttgaatgtgggcagccagctggtgaccgcctgcactatgccgtcggaatctatggcatagagcacctgaacgcgcgggtccttgagctcctccacgccgccgagcgtgaacttcatctcaggcagcgccttgccttcgctccactgctcggaaatctcctcgatctgcacctgcacctcatggggcgcctcatcgtaggtgctcatctcatcgacaatgccctcacgcttcgctttgttgatggccgtgcgaatgtcctgccacttcttgccggtggtcttccagctttgcgggtcaatgagcatctcgtctcccaccacaatggagtgccatccgagctgctgcaggtgatccttggcctcctcgtggatggcgtagaacaccggggaccatgaatggtcggagcagtagcgggcgaactcgtccatatcgctcatccattcatccgggtcgccgaacggtccggtggtggtcaatgcgatgtggttgagcacacggtaggcgacagcggaccttttgctgggcgacagccagtattcgttgccctcccacgtcgtcatgaagctcatggactcgccgccgtcttccaccagttcctcggccagcgcatgggccttgtggtcatagtcgattgacgcgttgagccacgcgaaggagaccacgacgagcacgatccagaacacaatgcccacgccctgcagaacaagcgaagccaacggggtgacggcgatgaacgagatgctcgaatccgtcagatacccgatcggcaggaaccttgcaggccactcgcgtagcaccatgcccacattcggatgcggcgtgaaatcctgaggtcgcaaacaggcgaacagcaggtagatggccgaacatacgacgaaggcgatcacaatggcagccacacagcggcgaagcgtccgcggtttcgtgcgaatggagaaatgcgggagctctatgatcacggcaatcgcgtatatgagcggtataagcgcattgacgagaatcatgcgcggtatgttgcccatggtgatatgcagctgatcatccaacgaatacggcaacaggtagtaggagatggcgaagaacgcgctcgccgcatagaacacgatgctgctgatcgcggcggtgcgccgtcccagccacatgccccatgccagggcgagcatcaccagcagcggcagcaccgatcgcaccacgtcccccggttggctggcacgcatgagcgaatactgttggaggcagccgtcgaccacatggccgtgcatgcaggccgccaacaccccggtgttcaccgattcggggctgagcaccagtgccaccgacacgagagggccggcatgggatcgcgacgaagtcgccaccatgggtcccaaggcgagcaccacgccgatcgcgccgaagatgcggcgaatctcctgcgacgaactgtactgccaatgccactgctcggcttcgattggcttgccggcaatcgcacggcctatgatctgcccgatgatcgcggcgaacagcacgcaataatcgccgggattgccgccgtagagcaccacgaccatgatggccgtgtagccgatgatgcgtatgcgtctgcgccacaattggtatgagaacgccgtcgccgccatgagcgcgccgatcaccagcacgacgggggagagcgtgaagctgatgttcagcacctccgcacgttcgccgagcatcgcgctgatcgccgaacagatgatcaggcctacgagtgtgccggatgcggcgctcaccagactgatggcggctgtgcgggacttgccgagatagggttccgccaagcacagcaccaacaggatcagcagcgcatccacgatcatctggaacaccgaaccggtgaggaacagcgaggcgatgagatgccccacattgaactcgtgcagactcgtggtgagcgcatggcgtggcatcttgtggtgctcgatgttgtaccatgcccaccagcacacattgatcatgatgaagccgaaggtgacccacagggcgaagctctgctcgtggatccaacgccggatgtcgttcagcagctggttgctcaccggttgcgccgcataccgcttcggcgctttgggaggtttggggctggtcggcggttttgccgccgcttgcgtctgcccgctggcgacgccgtcattcgaatccgttgcgctcacgatatctccttcacttctgaatcggtcgggaactgcacattctcgttgcccaatcccatgcgttcacataaatacggcagggccacggcgaagacggcattgacggcatgccagtcgtggccccagttgctcactgcgaatctgaacaccgtccacccgttttcccgggcggtgtcgccgatcttgcgtatgttgtcgacggattcgccgtcgcgtgcgcccgcaccaaggatcatgagctgtttcgatggcgcattgttccgaatcgcattctgcggcacctgccgttcatatgccgccttatccccggagaaatacgcctcgaccatatggtctacgctgccctcggtcggagcgacctcaccatctactgccagcacattgccgtagatgttcggatggttcggcgccagctgcgtcgcgcatgtgccgccctgcgagaaccctccgatcgtccactgtgatgccttgtcgttgacgggcaggttcgctttgatccaatcgggtacgtcctgtgcaagatacgtttcggccttgccccatttcgtggtgtccgcacacaggctgttgcgcgtcgcagccgtgttttggtcggggctgaccacaatcggggcgagaccatggtgctcggcggcgaatctgcccaacacctcgattgcgttgcttgcggtgaagaaacgcgtgggggagcccggttggccggcgaacatcaccatgaccggcaatttcggcgggtgcttggcaaaggccgccggtggcagccacacgagcgcctcgcgcgccttgaacccggatttcggattcgggatgtccacatgcacgagtttgcccgattggggaatctgcgtggtgttgcggctctttgccaccgcctgctcgttccattcacgtaccgagatcgtgttgagcgaaagatccagcgttgagatgtgcgggtagggcgagtaatcgaatagactgcccatcgtctggtattcaccatagattgcgttcgcacgcaccgcggtggcgagcagcgtgaccgggatcatgacgatggagagcacgcgcagccagccatgggtcatcaccgcggcggcgatcatgaatgcgaacaggaacacgcccacaccgattgcgatgatcaccggccagccgagcgagaccccgaacagcaggagcacatccgaacacacataggtcgcggcgagaccgacgattccggcgagcaaccctatgccgagctgcctgaggaagcgcttgcgcgactcgcctttcctctggcatatgagcaatacgacgatgccgatcgccaccagtgtccatatggtgacggggaaccagccgctgattacatcgatggcgtagaaccagtccttgatacctgccatatgcgttccgctcctctatcggttgtcttttcctaccatagtgagagacggaagcgactcgcatgcgttctgtaatgcgctgaaaacgatacggaacatcattgatatgaatgaccgtcgccggtcagtccaatccttcaagaatgaactggccggcaacggtctgccggaatgttatagcctatccacgtgctatgcctgcaaagccttggcgccgatatcatggcggtagaacatgcctgcggtgtcggcgttatcgagaatttcgtagaccttcttccgagcgctcggaatgtcgtctgcgctcacttcgacgagcagcacgcgaccggagtcggcaaccagatcgtcgccctcgcgcttcacgccggcatagaacacatgggagtcggtaccggtcttgaactgcggtaccttggcccccttgagcacattggtcgggtagccgtcggcggcaagcaccacgccgagcgtcgtgccctcctcaagccaggtgaactcaggcgcttcgccatcaagcatggcctgaatggcctgcccgagatcgctgtgcagacgggggagaatcacctcggtctccgggtcaccgaaccgtgcgttgaactcgatcaccttcgggccgtcggccgtggcgatcaggcccgcatacagaatgcccacgaacggtgtgccttcggaggccatggcttcgacggttggcttgacaatggtctcaagggcctcgtcgaccacgtcctggccgatctggggcacaggggagtaggcgcccatgccaccggtgttcgggccttcatcgttgtcataggcgcgcttgtggtcctgcgagatcggcatgggccagaattcggtgccgttcacgaagctcatgagcgagaactcctgtccctccaggtaatcctcaatcaccacacgggcgccggcggagccgaaacggtggtccacgaaaatgtcgttcaacgcatccaaggccgtttcgacgtccatcgccaccgtgacgcccttgccggcggccagaccatcggccttgaccacgatcggcgcaccatgctcgttcacatagtcggtggcgctcctaagatcgtcgaaggtgcggtatgcggccgtgggaatgttgtggcgttccatcagacgcttggcgaaatccttcgagccctcgatctgcgcggccgccttgctcggtccgaacgccttgatgccggccgcggccagcgcatccacaatgccttcgatgagtggcacctcaggacccacgaacacccagtcgtagtcgttgttgcgcacgaaatcgatgagcgcggcctgattcgacgggttgagcgagagcgtgcggatgccgtcgagctccatgcccgggttgccgggggcgacggtgacctcctcgacgcttgctcccttgagcagtgtgtaggcgatggcatgctcacgtgcgccggaaccgataacaagaaccttcatattccttttcacttccttggggaaactgtgccagtatgggtttggtctcaggccaggtcgacgcgttcgttgacctgttcgatcacatggccgacgcgataggccttctcacctgcatgctcgagaaggttcatcgcctcgtcaacacggtcggggcgaatggccacgaccatgcccaggcccatgttgaagatgttgtacatctccatatgatccacatcgcccgctttttcgatcacgtcgaagatcggcggcaccggccacgagccaagctcgatggaggcggccagaccctccggcagcatgcgaggcacgttctcgatgaagccgccgccggtgatgtgggcgacgccgcgaacgagattggcctcgaacagtggcatgagcgccttcacgtagatcttcgtgggggtgagcagcacatcgccgagttcccgatcgtccagctcgggaagacgcgtatgcacggtatagccggcctgctcgaacagtgccttgcgcaccagcgagaaaccattggaatgcacgccggtcgaaggaagcccgatgagcacatcgcccgcctcaatcgtcgacccgtccacgatcttcgatcgctccacgcagccgacggtgaagccggccagatcgtactcatcctcgtcgtacatgccgggcatctccgcggtctcgccgccgatgagcgcggcgcccgcctggacgcagccgtcggccacgccggagacgacctgttcgagcaccgccgggtcgttcttgccgcaggcgatgtaatcgaggaagaacagcggctgggctccctgcgccacgacgtcgttgacgcacatggccacgcagtcgatgccgatcgtgtcatgcttgtccatgagcttggcgatgacgagcttcgtgcccacaccatcggtgccggagatgagcaccggttcgttgtagccaagtgaggcgaggtcgaagaggcctccgaagccgccgatgccgctcaccacgcccggtcggttggtgcgtgcgacgtgtgatttgatgcgcttgaccacctcgtagcccgcttcgacgctcacacccgcgttttcatatgcttgtggcattgtgacctttctgttcgccgaaatcggcaagtcgattgatgaatctgtatgaatctgtatcgggaaaatctgggaactagatattggggacgagatactcggtgggttcctgggaggcatgctcgccgaacggcttctgcatcatcgtgtactcggtgccctcgtacatcgtcttcttgccgttgtagccgggcaatgtcacgcggtcttcgggggtgagcgagttgaggaagccctcctcgtaatcatcgagcgcggtggggtagtcgccgttgaagtacgcgacgcacaggccgccgtacggggcgtcggcgtgcaggccgatcgactcgatcaggccgtccacggagaggaacgcgagcgaatccgcgccgatgaactcgcggatctcctcgaccgatttcttcgcggcgatgagctcctgcgtcgtcgagatgtcgatgccgtagaagcacgggtacttgagcggcggcgagctgatgcgcatgtgcacttcggccgcccccgcctccttgagcagctgcacgatgcgtttcgacgtggtgccacgcacaatggagtcatcgatgacggcgatgcgcttgcccttgaccaccgacttgactgcggaaagcttcatacgcacgccctgctcacgcaatgcctgcgtgggctgaatgaatgtgcgggcgacgtattggttcttgatcagacccatctcattgggcaacccggcctcctcggagtagccggaggcggcggagagcgaggaattcggcacgccgatcaccatgtcggcatcgactggggactcctgtgcgagacgggcgcccatgcgttttcttgcggagtgcacattcacgccgtagatgtcggagtcggggcgggcgaagtagatgtattccatcgagcagattgacagctgcgtgcggctcgtgtacgtctgcgtgcggtagccgctgtcgtcgatcacgatcatctcgccgggctgaatgtctcggattcgttccgcacccaccacgtcaagcgcacaggtctcggaggcgagcacgtacgcgccgttcgtcatgcggcccagcgagagggggcggaacccattcggatcgagtgcgccgatcatctcatgttccgtcatgattaggtacgcaaagccgccgtgcacggtgttgagcgcttcctgcagcttgtcggtgatgccgctgcgcatggaacggcggatgaggtgcatgagcacctcggtgtcggagttcgaatggaaaatggcgccttcgtcttcgagcgcacgccgcagcgagaagcagttcgtgaggttgccgttatggcacaacgccatgtcgccgtcatggaagcggaacacgaagggctgaatgttgtcgatgccgcccgagccggccgtcgcatagcgcacatggccgattgcggcatcgccttgaagtcgttgaatgtctttttcgtcctggaacacctgcgtgagcaatccgagcccgcggtgccctaccaggtggccgtggtcgttggagactatgccggcaccctcctgaccacgatgttgcaatgcgtgtaatccgaagtaagtgaggcgtgcggcatcgggatgtccccatacgccgaaaatgccacattcctcatggatctcttcgagttctgcagacaagccgaagctccttccacaactggaataagggattcgctacgagataaaccctagcaagtcccggctacaccggcaaactcggattttatggaaatggcggatttccggcgaattgtgacggtgcgcccattcacatgctggactcgcggacgccgacgttgatgcatcgcgcccctttggtgtgacgcctattgccgattgacagattcgaacgtttgttcgataatctgtggtatgggagagcgaacatacttggcggtggatctcaaatcgttctatgcatccgccgaatgcgtggcgaggggcctggatccgcttgacgccaatctggtggtggcggatgtgtcccgtacgtcgaagaccatatgccttgcggtgtcgccggcgctgaaatcgttcgggttggggtcgcgcgccagactgttcgaagtggaggagcgtgtcggggtgctcaacgagcagcggcgtctgcgtgcgccggggcacaggcttgcggggtcgtcggtgagcgcggcgcaactgcaggctgatccacggctcggcattgaatatattgccgccaaaccgcgcatgtcatactatttggacaccagtgcgaaaatctacggcatctatttgaactacgcctcgaaagaggatatccacgtgtattcggtggacgaggtgttcatcgatgtcacgaaatatctcaagtatttcgggtgctcggcccatgaactggcacgtcgcatcgtggccgacattctcgagcagacgggcatcacggccacggcaggcatcggcgcgaacctgtatttggcgaaagtggcgatggatatcgttgctaagcacatccccgcggatgaggacggcgtgcgcattgccgaactcgatgaacgcaggtatcgcgaactgctgtggtcccaccggcctctcaccgatttctggagggtgggccgtggcatagcccgcaaattggagcggcagggaatcatgaccatgggagacattgcacggtgttcgttgggaagggccggcgaatattacaacgaggatctgctctacaggttcttcggcgtgaatgcggaaacgctcatcgaccatgcttggggttgggagccatgcacaatcgccgatattaaggcatatacgccggagaattccagcctgagcataggtcaggtgcttgcgcgtccctatccgcatacacaggcccacaccgtagcgagtgagatggcggactgcttggcgcaggatctcgctgccaagggggcggtgacggaccaggtcgtgctgacagtgggattcgacagggagagtcttatggacggccggtacctcgggcccgtaggcaaggatcactatgggagaccagtgcccaaaagcgttcatggctcatgtgatctggggcggttcacgtcatcggccactgccattcgacaggcggtggtggatgttttcgaacgcattgcggattcgcggctgtatgtcagacgcctcacggttgtagccggccgggttcgtatgctgggggagacccagaccttcgagcagccgagtctgttcgaggatctggagggctcgcaaacacagcagcaggctacggcagatcgcaaggaactgagtctgcagcgcaccgtcaacgcactgcgcagccggttcggcgcggcatcggtgatcaaaggcgtgaacctcgatgagggggcgaccggtatggaacgtagcaagcagatcggaggccatgcggcatgacgctcgagaacctgcaccgctacgacgacatcatcgacctgccacatcaccgatccaccaagcaccggcatatgagcaacttggaacgcgcggtgcagttcatgccgttcgccgcgttgaaggggcacgacgagcgcgtgagagaggtgtccagcacgccctgcacccgcattgcattggccgatgacgaaagagagacactcaacgatcgtcttgttgaggtaatcggtcaactcgaatcgcatccctatgcatccatcacctatttccagccggagggcggcagagatgccggcgagtatatgacggcggaaggggctgtgcggcgattcgaccagatgcgcagggtcatcgttatggaggatggcacacgtatagccctggtgaacatcgtggacattcgctgctgagtcggcatgaaggtgctttgcgctcacggcgtcgcattcgtgcgtgcctatgatggcgtcatggcatacgacaatggcaatgtgatcgacgtgcgggcgaacacgacgctgagcacggagaatgcgatcaaaggcaacgtacttgtattgggcaactcgggtgtgggcaagtcgacgttgatcaacgcggtgataggggacactgtggccaaaacgagcttcggcacgcggggcaccaccagtgagctcgccgtctatgagagcccaacggtgccgttccgggtcatcgattcaatagggttcgaaccgtctcccatcaaaagcctcagagcggtgcatgcggtgcgcaaatggtcgaaggcgagcgccaaggaaggtcatgagcacaacaagatcgacgtgatctggttctgcgtggacgggacagcggcaaagctgttcccggagacaatacggaatctgtccacggccgtgtcgatgtggcggtcggtgccgatcatcaccgtgatcacgaaatcgtattcgaaaccggaccgcgagctgaatgtgcagatggtgcggcaggcgttcgcggggcagcggatggagaggaacctgcgcgcgatcatacctgtggtggcgcagacctatgtgatcgacgaaaccgcgttcgccggccccgagggaatctccgatctcatagacgagacgatgaaggcgatgccggaggggatgcgcggtggctcgcatgatctcatggcgttcaaactcacccgcaaacgagtgctcgcgcaaggtctgatcggcgcttgtgtggcggcgggtgccacagtgggcgccgtgccgattccaatcgccgactccttggtgctctccccgctggaactgggcgagttgcatggcctggcgcgactgtatggcatagacaaggatgaagggtcgaagcagttcctggattccatcgtgcaggtgggcacggcaagcgtggtggcgcattccgcaatcagcgcggtgaaatcgattccgggcgtcaacatcgcggccagtgtgctcaatgcgattgtggcggcgagcatcatcgccgcactcggtgagggtgccgtcatagccttcgagcaggtgtacagcggcaagcgcagcgtgaacgacgtcacctgggtgcagaatctgatgcaggagcagttcggcgaagggttcctcggcaaggtgagcggtgtggcgcaggcgtcggccaaggccggcgatgcgaaggacatgcgtgagatgatcgtggaattggtcaaggccgcgttcatgaatcggggggagtaatcgagtaatatgcccggcgacatccctcttcttgcgaacgcatcgtgcttctgtaagagtgtaggatgtctcatccaacatctcctgctaatgtgacccgacatgaatttctctgatagagtagttcagggtaggtgatgcaagagaaaggctgtcggcgaggtggatggaaacaatgatgccgggaggtcgattccggcgatttcgaagaaatggaagattgccggtgttgttattgccgcgttgtcctgcatggtggtcggatgtctcctcatgttggggttctactcgctgttcccgggaacgatgccagcgttcctgaaggagaaggtgggtacctctgatacccaggtaattcgctccatggagcggacgaaagaggtggcactgttgcggctcggtattacgggcatcatatcgcaggagaacaaaagccatttcttcaatatggagattcccggtacggagcgggcgcggttcattcaatatacgttcgacgcgaagcttggattcgaaggaaaggacgtttccattaaggaaacgggcaagaacacgttcgatgtcgaaattcctgaattcaaattcatcggctacgaccatcccgaataccgaatgatcgtcgagcagaatggcgcgctaagcttcggtacccaacaaatagattccctcgacatgatcaataacatcctcactgagaagacgaagcaggaatatgtcgattcgaacagggatctgctcgaagagcaggcgaagtcgttctatgcctccatcgtcatgggtgtaaatccagaggcgaagcttaatttcacattccaaaccccaaagggttcgtgagattgcaggggcgtgctgttggatctttgggggaatctgctgagctgctagattcctaggggatgctgtttataaaggccgctctgaggttggctaatcattggttgattagccaacctcagagcggccttgtgctgttgtgggtgaatgagcgtgtgcgattagtcctatcgcatgtcagatggcaacgggtgcgccttggcggtgaactcggtcgagataatctgccagaccgcgaccttgctcacctgacgcggcagcagctctacgttgtgcatgtccgtgcgttgcttcatcagcagtttcagcgcgtcgatcttctcgtgctcgtcgttgagcaggctcgctactccggtgccgatgatcgaacggtatgccgtcgaggtggcgcatggtgtgcgaccggtatagatcaacgagtcgcagtccatctcgaatgcgaccggcaatgcgttgccggatgcgtgaatcgcctcgatcttgcgcccctgcgtcgccgaatgcatgagcagacgcaggttatgggaggaatcatcgttgttgtagacgaaggcgaaattgaccggtacgatggtgagtccctgcgcatcttgataggccacacgcacttcagtgcagttgcgcaggatgtcaattatctcctcgaacgagcgaacttcacggtcggctcgacgcattgggcgtgttgtcgatggtttctccggtgtagatgggtgcatctgcctttctccttgtattttaatctgtgggggcagtgaacgcttgcgtgcgtaatggcaggaagtctatcgtatgagtcaataacgcggcgacagtcatgtgacataacaatggtggcaggggttctggtttattcgcagattatgcagttgcctgctccgtgggggtggggtaggcgtctttgagcagtgtcgagaaggactcgctcgccattccgtagaatgcgccgatgatgagctggaatgtgaggtcgtcaggcaaatcactgtcggaggccagcgattccatcaacgtgttgaaccgttccgggttgctcttccagagtgtcgacatctcatgcagcgtcaacagtttcgaagcgacgctcgcgaatttgggtgattcgaacagcgcattgagtgtctcggatcgatagttgcgcatttgcgaatccgcatcctctccgatgatccatccccggagcgccgcgaccgactctccgctcattcccaagtattcactggcatgttccagatcgaaactcgtctcatccgtctcgccggtgagatagccgacatcgaccccgaagaagtcggcgatcatcgccatcgtttcgtatttcgggaatccgattgtgccggtggaggttttattgcccgaattgagccatctgcttacgtctttttgatggaaccgtgagagatattgcttgttcagctcgctcacgaatgcggcttgagtcagttcgtgggcatccataagttcctgcaaacggctccgccatatctccatattagattgagatataccatacatgacatgttttctttcaactcaacgtctaatttataacattatacgtcattgacaccatattgagttgcgaattaaatggattccagatgaagcaactcgtcggaatcgttgaaatttcgggcattcatgcagatggaggaaggattcgcgaaaaaaacatgccccttgatgacgaggaatgcaagcccgctgggcttggcggtccaaccggccgttcgaaccacctcgtcagaaaggaatgcagccatgtttgcccagatagccagcatgattctgcgaggtatacgcgaatttgacgaagtggcccgtgagctggagaaggacatctcaggcgacggaagccagcagacgaattcagggcaatcgacggacgcgaaaacggaaagatagcgcagcgtggcattcgcgtagatgcaaatcaaatagcaggcggtgagggagcggaactaccctcaccgccgcacatcaccaatacgaacaacggaagggaatcatggcagaccaaatctatatggcgtcggtggagagcacctacgccgccatggaacagatgcttcaattcagcgcagtgctggacgtcgtgagccgaaatgcagatgagcgcactgtcacgttcagtgtgccgggaatcaacggattattcactgcgaaggtcgcagaaggggatgccgcgggttcaagcaaggtgacggtgacggcaccgatcgatggaggcgataaagcacaggagtcggtggcgaaattctacaaggacctcggtgatcagctgatggtccaaggtgcggttcagtctgcgccgcagcagacccccgtattcgacgcccagaatcagccgacgcagacgttccaggcgcccgttccggccgctgccggcaacggcggaaatccggcgcagggaacgaagaataagttcgtcgcgatgctgaccgacaccaatacgggcaaaacttctgtgatggcgattgccgcggcagttgtgtccgcagtgttcctcattttcggattcgtgtctctcggcatgcaccctcccgtcgtggtgggcattatcttcgcggtggtcgccgcggtgctgtgtgcgctggcctatacgaagacacaaccgggtagggaacatggtcgcatgctcaccgtcgttgccgcaggtgtcaccgtggtagcgctgactctctcgctagtcggtgcggctggcggttccaagtcgcatggcagtatgaaggaagcatcgtcgtcgagttccccttcgtcttccgacgatgatccattctgtaagcccattagttggcctagcgctggtgttggggcgaaggctccgaaaccaaacagtctgaaggggtacgtgtggaccgacgatgccgattatgtgaatatcaagctgtgtgatgtagatgatgccgcatatacggactatctcaacaaggtgaaggacagcggcttcgttgaagattataagagcacatctggtgactacagtgcaaaggacagcgaaggcaatttcattgatctgacgttctttagctcgctcaccgagctggatgtaacagtcaaatcagctgaacgatatcagaatgatttgagtgaaaaagaaaagcaggaggaggaagcggaagcaaagaagaaagctgaggaagaggcaaaaaataaagccgaagcagaaaaagccgcagcagaggaggcaaagaaagcggaagaggaacagaagcggctggccgaggaggagaagaaactcaaagaggaggccgccgagaagcagaacacgcagagtaatgctgccaatggtgtgactcccgacgtgaaggaggccttggatggttatgagaccttcatgaataagtattgtgatttcatggagaaatacgccaaggaaggccgtcctgcaggcatgcttactgattatcttgagatgctcaacgagtacaccgattacacacagaaattgagcaatctggatcagtcagcatggaccgacgcagacatgaactacttcatcgaagtaaccaaccgtgtcaaccagcgtcttgcctcggtcagctgatttcatcgcatcctcggaagacgatatgagcgcctcgactcccgccgtgaaccgtgtgcctgtggcgcggcagacattccgcgccccggtcgctgaagtgtacgccgcgctcgtccagacattgcacttcagtgcggggtttgacgtcgtcgccaacgatgacgtcacgcattccgtgcgattccggctgccaaatgacaacggcgagtacgaggcccgggtcatcgctgatggcatgcacagtgcggtgatcatcgaagctccggcggggacggcgggcggaagcgcagcctacagtcggctgtaccgagaattggccgaacagattgttgcgcagagcaccgttgtaccccatgacgtcatcgccaaacgcagattccggcaagccattgtcgcagacaatgatggtccgagatcaaagtgggcgattggtgccgtcgtcttcgcatgtggtgcgctgctgggagcgttggcgatgttcagcgacctgcgtccggactggcaggtgtgcgtcacgctcatcgtctcgctgtttgtcgtatgcggcatcgcgttcgcggttaccggccgcaacggtaaggtctccgggagaaatctggtgctgatcgctttcgccatctcctgcctggcatcggtgctgctgttatgcgcgaccatagtggtgcagatcaggtattctaccactcttgcgatatccgagacgatggcgcaaacagcatcagcgctgcccctcgaaatgccaaaacaacaataaccgatcaatcatcaatctggaacaactattgaggagtaatatgaacaagaaatcattggcaggcccacgcgccctcacgatcattggatcgcttgccatgctcgtctcactcgtactgccgtacgccacgtcgagcaatgacaccatgacggcgttcaccatcgccgaacgatggaaggaaatgcagtcggtcgcgaacatgagcgtgggtgtttccgaaatcattctcgtgatgatcattgccattgcaatcttcaccgtgctggcactcatcttcgcccttgccgcgaaaggcattccgacgcttgtctttgtcgttctcgccatactcgcatacgtctacttcaacctgagcttcacaccatacggttcatatggcttcggtttcggcgtctacctgttctatgtggccgccattgcagtcatcgccggatccatctggatgatcgcaatcaaacgccacaacaaagcagccatccccaacatgtgacgggtgagacagttctgacgagtggaaatcgagacaggccgagcatgttccgcgagaagtagggaggagctgtatgcgtagcgtcaatctgctgccaaatgaggggattgttgcgcaattcgacagtgtacgctgtgagagtcctgatttcaaaggatgcgaatctggagaactgaccttcaccaccatgagtctcatcttctcctacacccaggtcaaggtgtttggcaaagacattgagcacaccttcttgtgggcattgcatgacatcaaagtggtggacggcaggccccagctcattatcgacaagggtgacgcccaccaatgcgacattctgctccgtaagggaaagctggaactgcgcatggactcgcatgcggatctggtgacgttggcgaacggcatcaacaagctgatcacggggaacgatgaagacattgtcggcgcaccgaaaaccttcatctcgggaatcgccagcatgctgagcgacgcgggcaaggaggtcaccgaagccttcggcctgagaaacacggcaaatcccaagagcgccgaatcgaaaatggtctcgcgcgcctgcgcaggttgcggtgccccgctgcacgggcgccaaggtaccagcgtcacctgtgaatactgcggtaggtcagagcaactctgaaccaccacgaactctgtgaaagaaggcagcaatggcattgatcagagcattcgccggagcattgagcggcaccttcgccgatcaatggctcgacatcatcaccgttgggcaattcgacgagcatgctgtgctcatgcccggcatctaccaggagaccaaccgtgaccgcggctccaatacgaagcattcggaggcggtgatctccaacggttcacgcatctacgtgccggagaacacggccgcattcatcttcgaccagtccggcatcgagaacatcatcaccgagtcaggcggttacgaataccgcaccggcggcaccgatagcgtgttcgcaggcaacggcataggcaagtcgatcttcgagcagataggcgagcggttcaaatacggcggcgagccggtggcgaacaaacgcatcgccttcgtgaatctgcgtgagatccgcggcatcaaatttggcacgccggcaccgctcatgtaccacgacaggttctaccagaccgatctggagattcgtgcgcgtggcatgatgtcggtgcaggtggtcaacccgctcgcattcattcgccagttcgtgcctccgaacgtggactacatcagcttcgacgacccgaacacgaaatcgcagatcctctccgaattcatgcagtcgttctcggtggcgctcaactcgctgtcaaacgaataccgcatctccgcgctgcccagccaggcgaattccattgcgctcgcgatctcaggggattcgtcgaatgccggcacatgggagtcgcgtttcggtctgcacttggtgggcataggcatcgagagcatcgaattcaccgacgaatcgcgtgagcttgtcaagcaatactcgtcgaaccgcatgaatctttcggcatacgagaacatctcgcagcaggcttcgaacatcgccgcgcagcagaagatcgccgagggcgtgcagcagaacgggttcggcgacatgggtggcatgatgctcgggcttggtttcgcgcagggagtcaatccgatgaccggcgcgatgccggggcagtctgtgcctactcagacgaatccggccgcggcagccgcagtggcagcggatgcgcagggcaccgtcgcgcaagctgccgcacaacctccggctgcacagggaacgcaatccgccatgtcggtgacggagcagatggaggcgcttaagtcgctcaaggagcttctcgatgcgggaatccttacgcaggaggaattcaatgtgaaaaagcggcagattctcggcctctaggagacctatcggcgattgttggggcgggtcggaaaaccatcttcgattgttaggtgggtgctacgagtagaggcggcccgaactcaagcaaaaatacgacagaataatatgttatgtctaataaaatggcgttaggaaggaataagtgccgaggataaccgcctaacaatcaaagatggttttccgacccgcctaataatcgaagaaaagaagtcgaatgcgttgatgaacagaagggcggtgtatgccatatatggcatacaccgcccttcgctatggtcgatcagcgtctataaccgtctcagccgaagtactcgacgccggcttcgaagatcggctggtagatgttgccgggcacattgcggtacaggccgtcgccggtgcgctcggagtggcccatcttgccgaacacgcggccatccgggctggtgatgccctcgatggcgagcatggagccgttcgggttcacactcaggtccatgctcggcacgccatgttcgtcaacgtactgtgtggcaacctgcccgtttgcgatgagctggtcgagcatgccgtcggaagcgacgaaacgtccctcgccatgggagatggcgatggtgtgcatatcgcccacctccgtcttggcaagccacggcgacaggttcgacgcgacgcgtgtgcgtacaagacggctctggtggcgtccgatggtgttgaacgtaagcgtcgggcactccgcggtcataggcacaatgtcgccgaagggcacgagaccgagcttgatgagcgcctggaacccgttgcagatgccgagcatgagaccgtcacggttgttgagcaggtcgcgcacggcctcggtgaccgccggtgcacggaagaacgccgtgatgaacttcgcggagccatccggttcgtcgccgcctgagaaaccgccggggatcatgatgatctggctgttatggatggcgtcgacgagcgcctgcgtggactcggcgacagctgagggcgtcagattgtttacaatgagcgtctgcgcctcggccccggcgcgttcgaacgctgccgcggtgtcgtattcgcagttgttgccggggaacaccgggatgatcacgcgcggcttggcgattttcgcacccttgtacacggtcggttccatcgtctcgaacgagatcgcgtcgaccgcctcggcttcggcatcggtttcaccgctgcggtaggggaacaccgatgcaatgccgttctcccacacctcctgcagattcgcgaggtcgagcgtctcgccggctgcgtggaacacgtagtccgcggtggtctcgccgatcggcccgatctcgaccagattggagactgtcggcatgttcgcggatggcgcgagctcgacgatgaacgagccatacgccggtgcgaacagatcgtcgacggcgatggagtcgtcgagcgccacgccgatgcggttgcccacgcacatcttgaacaacgcttctgcggtgccgccgtaagccggggtggagatggccagcgcatcgccgtcggtcaccaggttctcgatggtggagaacacctcgagcagtgcgtccttgtccggtgtgataccgtccgccagatagcgtggcgcgatgcggaccacacggtcgccggggtgcttgaactccggcgacgtggcacggttcatgtcgccgaccgccacggcgaaggagacgagggtgggaggcacatcgaggtcttcgaaggagccggacatggaatccttgcctccaatggcgccgaccccgaggtccacctgcgccatgagggcgccgagcacggccgcaagcggtttgccccagcgctctggctcgtcgcgcagcttctcgaaatactcctggaaggtgaggtatgccttttcgtgttcgaagcccgccgccacgagtttcgcaagcgattcgaccaccgacatgtaggcgcccgtgtactggttgcgttccatgaggaaggggttgaagccccacgccatggccgaggcggtggtggtctcgccgaacaccgggaacttggccaccatggcttccgccggcgtcagctgttccttgccgccgaacggcatgagcacggtggcggctccgatcgtggagtcgaagcgttccgacaggcccttgttggaggcgatgttgatgtcggagagcatctcgttcatacgctcactgagtgagccggacgagaatggggcacggtaggagccctgctggggcacgtgggcatcctgatgcttggcggcgccgttcgaagcgaggaactcacgcgagagatcgacgatcggctcgccgttccattccatcaccatgcgagggtcttcggtcacggtcgcaatgaccacggcttcgaggttctcctcggcggcatacttcaggaactcgtcgacgtcttccgcagccacatcgaccgccatgcgctcctgcgactcggagatggcaagctcggtgccgtcgaggccgtcgtatttcttgggtacctgattgaggtcaacgtgcaggccgtcggctatctctccgacggcaacggacacgccacccgcgccgaaatcgttgcatcgcttgatcaagcggcaggcatcaccgcggcggaacagacgctgcagcttgcgctccactggggcgttgcccttctgcacctcggctccatcgagttcaagcgactcaacgttgtgtgccttggacgaaccggtggcgccgccaatgccatcacggccggtacggccgccaagcagaatgatcttgtcgccgggggccggggtctcgcgacgtacatggcttgccggcgtggcgcccacaacggcgccgatctccatacgcttggccacatagcccgggtggtagatctcattgacctgaccggtggccaagccgatctggttgccgtacgaggagtagccgtgcgccgcggtggtgacgagcttgcgctggggcagcttgccttccagcgtctcgctgatcggcacgcgggggtccgcggcaccggtcacgcgcatcgcctgatacacgtaggagcgtcccgaaagcgggtcgcgaatgcagccgccgatgcaggttgccgcgccaccgaagggctcgatctcggtggggtggttatgggtctcgttcttgaacaggaagagccagtcttcgctctcgccattcacatcgaccttcaccttgacggtgcaggcattgatctcctccgattcgtcgaggccggtgagcacgccgttcttcttgagccacttcgcaccgatcgtgcccatgtccatgaggcacacgggtttctcgtcgcggccgagctcatggcgcatcgccatgtacttgtcgaaggcggccttcaccacggcgtcgtcgatttcaacggagtcgagctcggtgccgaaagtggtgtggcggcagtggtcggaccaatacgtgtcgatcaccttgatctcggtgatggtgggatctcgttgctcaccctggaaatactcgcgtacgaacctcagatcggcctcgtccattgccaggccccgatcggcgatgaactcggcaagctgtgcatcgtccatttcgcggaagccatcgagcacttcgaccggctggggggtgggggcataggtggcgagcgtctctcgggtctccagcccggcttcgcgggtctccaccggattgatcacgtactttttgatcgcggcgaggtcgtcgtcgcccaactggccatcgagcacatacacgcgggccgagcgcacggtcggtcgttcgccctggctgatgagctggatgcattcgcttgcggaatccgcgcgctggtcgaattggccgggcagcgattccaccgcaaacaccgtgtcaccggagacatccggcagttcgatgctcacattgtccacctgcggctcgctgaatacggtggggatcgtctggccgaacagctcctcgctgattccctcgacgtcataccggttgatgatgcggacgttgttcaaagattcaatgccgagaatcgtgcgcaattcgttcgtcagctgctgcgcctcgacgtcgaatccgggcttcttctctacatggacgcgaaaaaccactgtgcttcctcgttctttagcaataatctgggattgtaccgttgaaaacaatataggaaaacaagaaagggcctgttccatggctcaagtcatggaacaggccccaatgtcactcggcgcgctcgacgccctcggcttcggcgagcttgaccagccggtcgtagatctcctcgtaggcggggatgatgttgcccagatcgcggcggaacagatccttgtcgagatgctcgatctggccggagccgtccttcaggtcccacaaacggcaggtgtccggggtgatctcgtcggcgagcagaattcgcccgtcaccggtcttgccctcctcgatcttgaaatcgacgagctgcacgtcgatcttcgagaagatgtctttcaacgcatcgttgactgcacgtgcctggcgggagatctcgtcgagctcctcttcggaggcgatgccgagtgccacgatgccgtcgtcgttgatgaacggatcaccgagctcgtcggatttcacgcagaattcgaggatcggcttgtcgagcgcggtgccttcctcgacaccgtacctcttggcgaaggaaccggccgccgtgttgcgcatgatgatctcgagcgggtacatgtccattttgcgaacgagctgctcggtgtcggagatgcgcttgacgaagtgggagtcgatgccgcgcgccttgagcaggtcgaagatgacggaggtgatctggttgttgagttcgcccttgccttcgatctgtgccttcttggcgccgttgccggcggttgcctggttcatgtattcgacccagagaacatcggggtcatcggttgcgtacagtttcttggccttgccctcgtagagcttgtccagcttctgcatgtgctgccttccgttgtcaacaatgagtggacgttttcagcgtaccaacccaacacgccaaaaacgcccagtttactcactgttttcagtattcgacacgcggttttcgtgaggttcgcgagcggtggcgtcgacactacttcgccggattcaccactatgcgcagattctgcgcgcactcgttcgccttgatgcgcgcctcgtcgatgtcggagccgatggcgagcgtcacgcccatgcggcgatggccctccacccgcggcttcgagaagatgcgcaaatcggtgcccggtgtggcgagtgcggtctggaggttcgagaattcgacttcgccgttgccctcgacgacgatcgcatggctcgccgcgccgtaatacttcggcaggtcgagtccgatatgcgccttggagaccgggattccgagcacggcgcgcgcatgcaggtcgaactcgctcaaatactggctgatcatggtgaccatgcccgtatcgtgcgggcggggggagacctcgttgaagagcacggtgccgtctttgagcacgaacaattcgacgccgaacacgccccatgcggtgtcggtgccggcatgggcgatgagaccctgcacggcctgcgtggcaatgcgtttgacctcctgccgatgatcgggctcgacggccgcaggctgccaggaatcacggtaatcgccgctttcctgccgctggccaatcggttcgcacaccacaatgcctgccgatgagctcacggtgagcatggtgagttcgtaatcaaggtcgacgagctgttcgatgatcacgcgggagacatcgccctccccatgcgcacggcgaccggtttgcgcctcattccatgcgtcctcgatcttgtcggcggatcgcaccaccgactggccgtggcccgaggagctcatgaccggcttgaccacgcaggggaagccgatgcgagtggccgcctctttgagttcctgcaggcttcccgcgaattcgaatttcgtggtgggcagtcccagctcgtcggcggcgagctggcgaagacgctcacgatccatgcaaattgaggcgatggcagcgctcggcaccacgcggatgccggcctgctccgcttcgaacagcacgtcggtggctatggcctcgatttcaggaatgacgatgtcgggtttgacgtcgcctatcacattgcgtaatgcatcggcgttcgccatgtcgagcacccgtgcctcgtgggcgacctgtgcggccggtgcgccgttgtaggaatcagcggcgcacacccatgcgccgagccgcatgagtgaaatcgtcacctccttgccgagttcgcccgaaccgagcatgagaatgcgggtgggatgttcaccgaatggtgtgccgagaatcatggaatctgtagtcatggttccattgtgccatcagtcgtgtcattcgcggcgtgggggagtggattcgcaaaaagacaatgcgcgaataccgtgaaatatacagtccagcgggttagatgagcactatggaagcacacaacgaagcagcgtcgccgcagtcggcgtccgacaacgcaaccgataggccactgacgatcgcactggttgtggacactttcggcaaccgcggcaacggcacctcgaactcagcgctccaatgggcgcaggaactcgaacggcagggtcacaaggttcgattggtggggatcaatgcccccgaatatccggccagagagaaccacattccgttggtgagctggatttcggccaagcagcagatgcatttcgcccagccgagcgccacactgttcgaccgcgccttcgatggtgtggacgtcgtgcacatctacacaccgttcaaattcggccggcatgccatggcggcggcccgtgccaagggcctgccggtcactgctggcttccatgtgcagccggagaacgtcatgtattcggcagggccggcccgatggatccccggcatggatcggttcatctactggctgttcaggcgctggctgtattccagggtcgacgccatccatgtgcccacgaatctggggaagcaattgctgctcgaccacgggtatgccaaaccgatcttcgtcatctcgaacggctacgcaccgcggttcataccgaaggagcagcgcaagggcgatgccgcaccgcagattcccgtgcgcatcatcgcttcgggtcgcctttcgaacgagaagaaccatgtcgagctcatcgaggcgatctgccgttgtgcgcatgcggacgacattcatctgacgattgccggcacggggccaatccggaacaaactcgtgcgtttcgccaagaggaagctcaagcgtcctgcctcgatcggcttccacaagaactcgacgatgccccagttgttgcggtcggcagacctgctcgtgcatccttcgatcgccgacctcgaatcggtgagcgtcatcgaaggcatggcctcgggcttggtgccggtgattgccgattcgaaactgagtgcggcaggccagttctcgctctgcccgcaatcctcatacccagtgggcgatgtggacgcgttggccgaacgcatagactggtggatcgaccatcccagggagctcaacacgtggggcgacacctatgcgcgtcatacgaaggacacgtattcggtggaggagtcggtgaggcgtttcgtcgagatggaacgccagatcatctccgaccacacggtttcctcacgctaactgtagctgatcgttatgggctgggccctgcggatatgaaatccgcagggcccagcctgttacgggaatcagagcagcttgatgagctcgtccacctgctcgtcggtggtagcccagctcgtgcagatgcgcagcatcacatggtcggcatccacctgctccatgaatccgagcttgacggacttcgtgagttcctgcgcgcgctgcgtggtcaccacgatgaagatctggttggtctgcgagatgtattcgatgtcgtaatgcttctcgaagagtgccttgcgaatcttgtccgcctcggcgttcgcatgcttggcgagcttgaagtagaggtcgtcggtgaacagcgtgtcgaactgcagtcccaacagccagcccttcgccagcagtgcaccgtgctgcttgacgatcgtcgtgaagttcctcggcgaattaccgcgcgggaacacgacggcctctccgaacatcgtgccgcatttggtgccgccaatggtgaagacgtccgccagacgggcgagatcgggcagctgcacgtcgttcatgtccgccgtgagcgccatgcccaaccgcgcgccgtccacatagagaggcagattgtggtcatgcgcgacctgtgagatcgaggcgagctcctcacgcgtgtacacggtgccatattcggtgggctgcgagatatacacgcagccggggtagaccatatgctcatggttgaggtcgttttcgaagctctgacagtattcgtcgagctgttcgccggtgatcttgccgtcgtgctgggggagtgcgagcactttgtgtccagtcgcctcgatggcgccggcctcgtgcgtgttgatgtgcgcgctctccgggcatacgacgcctgcgtattgcggggtaatggcgctgagcacggtctggttcgtctgtgtgcctcccacgaggaaccagacgtcggcctgtgcggcatcacaggctttgcgaatcttgtttgcggccgcatcgcaatactggtccttgccatagccggagttctgttcgttcgccatggcctgcatgcgggcgacgatctgcggggcggcggtggaggaataatcgttttcgaaagacagcatatgcactcctgctcattgtggttacgtgcggttctgctgtgtagtctacgcccgggaaccgagcgcaagcaccattgccgcgcacggtgaacgccatggcaaaatggggagggtggcgggacgccatcgttattcatcgttaccgaaacgaggaaaccccgggattcgttcggtttggaaaccgttggaatctcggggtttggccggggtggctaacgcggctcgaacgcgcgaccttctgaaccacaatcagatgctctaccaactgagctatagccaccatgtttacgtgtctgctgagcatcacgcaacagatgaaaactatacacgagggttccccgaaaaccggggtcggcgtgtcgcctatacaatcaatgcgggcgtaggtatacttggatatacaccaagaagaaacgaattccaagggttttgggcacgcataggagcgtgcggcgcagggagcgccaatgcggcataactcaacggacagagcagagaagtccatgaagtcatataagcgggtgcgatggcgattgcacggcctcgaggcgaggggccggcaggggaagtattggaaaccaaaatggaaacgcaatcgccgctatgtgcagaaaggccatatggttgatgcgcgtggcgatatgagtcgcgtatggtgggccggcggcacccggggtgtgcgggtgagtcggcaaatgtcgcaaatacggtggtcgaattggtggcagtgaatcgaatgcaagccatgcgcatgcggctgaggcatcagggtggatgcccggcctgtcggcgacagcaagccgaggcatgcggcagagagcgagaaatgtgtgccatatgtgatggccggcgaatggtggaatatcccgttcgccccgttgttgagtatggtgatgggaagctagacggccccggaggcacctagacactccggggccgtcttttgtctgccgtcatggtatagtagacgtttgtgtgtgccagcagtgcaccttatgtgacaggtgtacatgctgggatatccccgagttcgcgatgatcacgcgcagtaatgcggcggtgagagggcgaggggtcatcgggccggtgaacgttggctagctaatccgattcggagaagtgggtcacaaaggcgcggctccacaaagaagaacattacaaactgaatcggagaatcaagttgcctactattgaacagcttgtccgcaagggacgcaaggcaaagccgaagaagtccaagactttggctctcaagggcagcccgctgcgtcgcggcgtgtgcacgcgtgtttacaccaccaccccgaagaagccgaactcggcactgcgtaaggtcgctcgtgttcgtctgagctccggcatcgaagtcaccgcctatattccgggcgaaggccacaacctgcaggagcactccatcgtgctcgtgcgcggcggccgtgtcaaggatctgccgggcgtgcgttaccacatcgtgcgtggtgcactcgatacccagggcgtcaaggaccgcaagcagggtcgttccctgtacggagcaaagaaggcgaagtaagagatatgtcacgtaaaggaccttccaagaaacaccaggtgcttccagatccgatctacggctcgatcgtggtggcacagctcatcaacaagatcttgcttgacggcaagaagtcgatcgcggaggacatcgtctattccgcactcgatatggtcaaggacaagaccgatcaggaaccggttgcagtgctcaagcgcgctctggacaacatccgtccgtcgctcgaggtccgctcccgccgtgtcggtggcgccacctatcaggtgccggtcgaggtcaagcccgctcgcgcgaacacgctgtcgctgcgctggctgaccgacttctcccgcgcccgtcgcgagaagacgatggccgagcgtctcgcaaacgagatcctcgacgcgtccaacggccttggcgcatccgtcaagcgtcgtgaagacacccacaagatggcagaggccaacaaggccttcgctcattaccgctggtaattaagtcgagcaacgaagagttaaggaacattcatggcactggacgtgcttaccaacctcaaccaggttcgtaacatcggcatcatggcacacatcgatgccggcaagaccaccactaccgagcgtattctgttctacaccggtaagaactacaagatcggcgaaacccacgagggtgcttcgacgatggacttcatggctcaggagaaggaacgcggcatcaccatccagtccgctgcgaccacctgcttctggaaccgccagactcatgatccggacgagaagttccagatcaacatcattgacacccctggccacgtggacttcaccgccgaggtggagcgttcgcttcgcgtgctcgacggcgccgtcgcagtgttcgacggcaaggagggtgtggagccccagtcggagaccgtgtggcgtcaggccgacaagtacggcgttccgcgcatctgcttcatcaacaagatggacaagctcggtgccgacttctactactcggtgagcaccatcaaggagaagcttggtgcgactccgctcgtcgtccagctgccgatcggtgctgagaacgatttctcgggcgtcgtcgacctcatccgtatgaaggcatacgtttggaacgacatcaaggacgaccagggtgcccactatgacaccgtggagattccggacgatctcaaggaacgcgctgagcagtaccgttccgaactgctcgatcaggttgcggagaccgatgaggagctgctcgagaagtatctcgagaacggcgacctctcggagcaggagattcgtggcgccatccgtcagctcaccatcgcccgcgaggcttatccggtgctctgcggttccgccttcaaggacaagggcgtgcagccgatgctcgatgccgttgttgactatctgccgagcccggaggacgttccttccatcgtcggcttcgatccgtccgatgaatccgtcgagatcgaccgcaagcccaccatggacgacccgttctcggcccttgtgttcaagatctcgacgcacccgttctatggcaagctcgtgttcgtgcgcgtctattccggctccgtcaagccgggcgacaacgtgctcgattccacgaagggcaagaaggaacgcgtcggcaagatcttccagatgcacgctgacaaggagaacccggtagacgcagccgaggccggcaacatctacaccttcgtgggcctcaagaacgttaccaccggtgacacgctgtgtgacgagaagcacccgatctccctcgagtccatgaccttcccggatcctgtgatcgaggtggccgtggagccgaagaccaaggccgatcaggagaagatgagcctggccctcgccaagctctccgacgaggatccaaccttccaggtgaagaccgatgaggagtcgggccagaccctcatctccggcatgggcgagctccagctcgacatcatcgtcgaccgcatgcgccgcgagttcaaggtggagtgcaacgtcggcaagccgcaggtcgcctaccgcgagacgatccgcaaggccgtcatgaaccaggaatacacgcacaagaagcagaccggtggttccggccagttcgcgaaggtgctcatgaacttcgaaccgctcgacaccgagaacggcgaagtctacgagttcgtgaacgaggtcaccggcggccacatcaccaaggaattcattccttcgatcgatgccggtgtgcaggaggccatggaatccggtattctcgccggcttcccggtcgttggtgtcaaggccaccgtcaccgacggtcaggtccacgacgtcgattcctcggaaatggccttcaagatcgccggctccatgtgcttcaaggaagccgccccgaaggcgaagccggtcattctcgagccgatcatggccgtcgaggtccgcaccccggaagagtacatgggtgacgtcatgggcgatctgaactcccgtcgtggctccatccagtcgatgaacgacgccaccggtgtcaaggtcatcgacgcaaaggtgccgctgagcgagatgttcggctacattggcgacctgcgatccaagacccagggtcgtgcaatgttcaccatgcagatggactcgtatgctgaggtcccgaaggccgtcgcagacgagatcatcaaggcccagcgtggcgagtgacatccgttacgaatcacgcacaacacaacttgaacctgtctccagtcggcgctagaattctgtagcgctgactgggttcgggtccaaagtggcaaaaacccagaaacccagtaaaatgtagcaagtgccttgagtgatcaaggcttactacgagaacgtccaggaggacaaaaacatatggcaaaggaaaagtacgagcgtactaagccgcacgttaacattggtaccatcggccacgtcgatcacggcaagacgaccctgactgcagcaatctccaaggttctgcacgatgagtacccggatctgaaccctgagtacgacttcaaccagatcgatgccgctcccgaagagcagcagcgtggtatcaccatcaacattgcccacatcgagtaccagacggccaagcgtcactacgcccacgtcgactgcccgggccacgccgacttcgtgaagaacatgatcaccggcgctgcccagatggatggcgccatcctcgttgtggccgccaccgacggcccgatggcccagacccgcgagcacgtgctgctcgcccgtcaggtcggcgtcccgaagatcctcgtcgctctgaacaagtgcgatatggtcgatgacgaagagctcatcgagctcgtcgaagaagaggtccgcgacctcctcgacgagaacggcttcgaccgcgactgcccggtcgtgcacacctccgcttacggcgctctgcatgacgacgctccggatcacgacaagtgggttgccaccatcaaggagctcatggacgacgtcgacgagtacatcccgaccccggtccacgacctcgacaagccgttcctgatgccgatcgaggacgtcttcaccatctccggccgtggcaccgtcgtcaccggtcgtgtcgagcgcggcaagctgccgatcaacacgaacgtcgagatcgtcggcatccgcccgacccagaccaccaccgtcacctccatcgagaccttccacaagcagatggatgagtgcgaggccggcgacaacaccggtctgctgctccgcggcatcaaccgcaccgacgtcgagcgtggccaggtcgtggctgctccgggttcggtcaccccgcacaccaagttcgaaggcgaagtctacgtccttaccaaggatgagggcggccgtcactcgccgttcttctcgaactaccgtccgcagttctacttccgcaccaccgacgtcaccggcgtcatcacgctgccggaaggcgtcgagatggttcagcctggcgatcacgcgaccttcacggttgagctgatccagccgatcgctatggaagagggcctcaccttcgcagtgcgtgaaggcggccacaccgtcggctcgggccgtgtcaccaagatcctcgcctgattccaatgaatcaagcgtgcgacagacgcgcatgaactagcgttcccaaaaggctccacaggaaactgtggggccttttgcgttgtccgaaggcaccgattccgaagtgtccttgcgcatatctgtcaacacaggggatcgtctatcgtgttgccgaatggcaacagctcgggtggaattcaccaaggggagaaaaggagcaccgcaatctacaaataacaaaaggcgccgcaacagcggcgcccagaaacggcaaagctcaataaaaaacagtcagtggctcagtcggcggaatcgatgggtgtggattcctttgcggccggcatcatacggtccacggccatcagaatgtaaccgagcacaatgaatgcggcaagcagaatcaggcaccaacgcaccacgcctgcaatgccctgctgattggcatcgatgaagaaatacgggtagagtttcggcaccgcggtgtcaaagttgaccagccacgcgcgcatatagacgaaggcgaggtagacaagcgggaacaccgtggaatagagcgggtacgtccacttcactttcctatgctcgtagaacaggagccaatcggcaacgaacatgagcggcagcaccacatggaacgtgatgctcgtgactttgaagttctcgagcgggttgcgatccggtgcattggcaagcagcaggttgaacacgaagaacgtgaggagaatggcagtgaccgaaatgaacttcaaggcgggggagagcttcacatagccgtcttgcttgcggttggccgtctgcacgagttcgaagaacatgacggcaatgcacaggtaattcgacaggttcgtgaaatacacgtagaacacgttgtcgaagctgccgtcatacatgccgaagctgccgagtattcccactatgccgaatgcacagtagaacgattggaaaatgagttgagcggttctgctccgtaccatagaaaaacctttccgcaatgcccctgaattcgggcgacccgcatattctatgacacgattccatacaaatactatgtggatgcacacaaaattcgtcatgttcaagtgtgcatccacacagcaaaccgggagtgttcgcgttacctcacgtcgatggtgttgaggccctcggcatgaagatccacttcggtgaccgtgcgaatcgaatcgtcggcggagagttcgatgaccaccggattcattgccttgatggcggcgtcggagaactcggtgtggccggacggcgagctcttgagcaggatcataggcagatcggaggtgagcgtttgcgtggcatcgtcgatattgccgtttatcatgagcacctgaccgttctcctgaccggagacatccatcagcatgcgaacgatgtcgccgcggcgcatgcttgggcaggcgatcgtatcgagcttgtcatcgcgaatgatgcggtggatcgcatcgacacccttgagcttggcatcgatcaccgtggcgttctcgggaatctcggccaacgcgccgctctcatcgatcacaccgagtcttgcggattcgggcagattcgcgagcagggactcgaagagcgcgagcttggcggcgatggtggcgcgaccgacgatgatgaccgaacggcggttcgcgagtgcatcggtgatgcgtgaatctttgatttcctctgacatggacatccttactccttgcactgcacgggtgtgcagacggcatacagattgttgatataccccgtcaatctgtggaatggtgcgaagatgccgtgtattgccgccgggcgaacagaaaaatgcggtgcgatgaccaggcgatgcaggtctgagaaatggacgcgaacgtgcgtgcacgacgaaaacggtgtacaacagtgcacatatgactgtagagaggtgctggcataatatgcaaggctctatatagctgtatagtcgacacgaataggtgagtaatttggcacagactactaacgacatcaagaacggttccattctgaatctcgatggccagctctggcaggtcatcaagttccagcacgtcaagccgggcaagggccccgctttcgtgcgcaccacgatcaagaacgtgctctccggcaagatcgtcgacaagacattcaacgccggcatgaagatggatttcgagaccgtcgacaaccgcacgctgcagtactcgtatgaggacggcgacaacttcgtgttcatggacatgaccaccttcgaccagatcatgattccgaagacgctcgtgggcgacaaggccaagtacctcctcgaaggcaccgactgcatcgtctccttccacgacggccagccgctgtcggtggaactgccggcatccgtcgtgctcaccatcacccacaccgagccgggtctgcagggtaaccgttcgaacgcgggcaccaagccggccaccgtcgagaccggtgccgaaatccaggtccctctgttcatcggcgagggcgagaaggtgaaggtcaacaccgacgacggctcctacctgggccgcgagaactgagatcggccactcgcactcacagaagcaggacttgcgggcggggattggcatcgcatgccggtgccccgcccacagtgaagaaaaggataagcttgtatggcacgttcgaccgctcgtcgcagggctctgaacacgttgtatgaagcggatgagaaggggcaggatttcctgtcccttcttgatgaacgcatcgctcagcccggtgcacagacgccgcttcccgaatacgccattgagattgtgcgtggcgtggatgagcaccggcgtgacatcgattcccagctcaatacgcattccaccggttggaaggtcaagcgcatgcatgcgatcgaccgcaacattctgcgcattgcgacgtgggagattctctacaacgacgatgtgcccgacaaggtggccattgacgaggcgctgaatctgtcgaagacgttgtcagacgatgcggccccttcgttcattcacggtgtgttaagtgccattgtggcggcgaaggacaagcagtccccgcagtccacaccattggatgattccgacaaggacgaatccgaccaaaccaattagcaggtaatcgcgttcggccggatcgcgactctcaaccggccgctttcctcaaatacttttgacgaatgggggtatggtgactcagttcgatccggcgaatgaatacacggctcaggatgccgttctcgtgcttgaagacgggcaggtgtacgttggcgagccattcggtgccacgggatccacctgcgcggagatcgtgttcaacaccgcgatgaccggctaccaggaaacactgaccgacccgagctacgatcgtcagatcgtggtgcagacgttcccgcacatcggcgacaccggcgtcaacgatgacgatttggaatcctcccgcatctgggtcgcgggctatgtggtgcgcgacccgagcatggtggtgagtaactggcgcgccgcagggtcgttggatgacgatctcatggccaaccacatcgtgggcatctcgcatatcgacacccgcaaactcgtgcgacacctgcgctcggcaggtgtgatgcgtgcgggaatcttctcgggagcggcgcttgtcggttccaacggcgagccccgcgagatttccgacatgctcgaagaggtgcaacgaaccccgcagatgaagggcatgagcctctacgacgaggtgagcaccccggaagcctacgtggtcgagccggctggcgacttcgaaggcaaggagccgttgttcaccgtggccgcggtcgatctgggcatcaaggccatgaccccacaccgcatggccgagcgaggctgccgtgtggtcgtgctgccttccaccgtcaccttcgatgagattcaggaactcaaccccgacggggtgttcttctcgaacgggccgggcgacccggaacaggccggccagatggtctcgttgctgcgccaggtgctcgacgccggctacccgttcttcggcatctgcttcggcaaccagttgctcgggcgtgcccttgggttcggcacctacaaactcaagttcggtcatcgtggcatcaaccaaccggtcaaggatgtgaccacaggcaaggtggaggtcaccgcccacaatcatggcttcgcagtggatgcgccaatcggtgagacggtggacgccccgtttgagaacggtcggtacggcaaggtgttcgtgagccatgtcgatctcaacgacaatgtggtggaaggcctgcagtgcgtcgatattccggcgttctcggtgcagtatcaccccgaggcggcggctggaccgcatgatgccgcctatctattcgaccgcttcgtttccatgatggacaattcccgagattccaaggcttccaaggaggagaacgcgaatgcctaagcgcacagacatcaagtcggtgatggtcattggctccggcccgatcgtgatcggccaggcggccgaattcgattactcgggcacccaggcatgccgggtgctgcgcgaggaaggcgtgcgggtcattctcgtcaactcgaatcccgccacgatcatgaccgatccggagatggccgatgccacctacatcgacccgatctcgactcccattctcgagaagatcatcgccaaggaacgcccggatgcattgctgcccacgcttggcggccagaccgcattgaacgccgcagtggctcttggcgaggccggtgtgctcaagaaatacaatgtggagctcatcggcgcctcgctggaagccatcgaccgcggtgaggaccgcgagtcgttcaagaaggtggtgaaggaggcaggcgccgagtcggcgcgctccgacatcgcccacaccttggaggaagtggacgccattgccgaacgattcggcttcccgctggtcgtgcgtccgtcgttcaccatgggaggccttggctcaggcatcgcgcatgacaccgaggagctgcaccgcatcgccggtgctggcattcactattcgccgaccgacgaggtgctcatcgaagagggcattgagggctggaaggaatacgagctcgagctcatgcgcgaccgcaacgacaacgtcgtggtcgtctgcccgatcgagaacgtcgacccggtcggcgtgcacaccggcgactcgatcaccgtcgccccggtcttcacgctgaccgaccgcgagtatcagaagctgcgtgacattggcatcgcaatcattcgcggtgtgggtgtcgacaccggcggctgcaacatccagttcgccattcaccccgacacgggccgcatcatcgtcatcgagatgaacccacgcgtatcgcgttcctccgcgctggcgtcgaaggccacaggcttcccgatcgccaagatagccacgaagctcgcgctcggctatacgctcgacgagatccagaacgacatcacgaggtcgacacctgccagcttcgagcccaccatcgactatgtggtcaccaaggtgccgcggttcgctttcgagaagttcccgggcgccgatccgacgctgaccacttcgatgaagtcggtgggcgaggccatggccttggctgggaacttccaggagtcgcttgggaaggccatgcgctccatagacaaacgccatatgggcttcagctgggacggcgagaagcctagcgagggcgaggtgcacgagctgctcgagcagatgcgcattcccaccgaacaccgttacctgcaggtcatgcgtgcgatctggggaggtgcgacgccggaacaaatcttcaacgccacgaagatcgacccgtggttcatcgaccagttcttccagattaacgctaccgccatgcaggtgcgcggcgcagagacgctctcgaagcgcctgctcaggaaggcgaagctcgctggtctgtcggacgtgcagatcgcacatctgcgcagactcggtgacgaaggcgaaaacacgattcgcgaactgcgctggaactacgggctgcacccggtgttcaagacggtcgatacctgtgccgccgaattcgccgcgcaaacaccgtactactattcgtgctatgccgatgagaccgaactgcgcaagagggaacgcgaggctgtgatcattctcggctccggacccaaccgcatcggccagggcatcgagttcgactacacatgcgtgcacgctgtgcaggagctcggcaaggactatgacacgatcatggtcaactgcaatcccgaaaccgtgtccaccgactacgacatgtcggatcgcctatatttcgaaccgctcaccttcgaagacgtgcttgagatctatgaggccgagaagaagcagggcccgatcaagggtgtgatcgtgcagctcggtggccagacgccgctttcgctcgccgcacgtctcaaggccgccggcgtgccgattctcggcacgacccccgaggccatcgacttggccgagaaccgtgagctgttcggtgaggtgctgcgtcaggaacatctcaacgcgccgcgtttcggcaccgcgctgagcctcgaagaggcccgtgaggccgcccacaacatcggctacccggtgctggtgcgccccagctacgtgctcggcggccgcggcatggagatcgtgtacgacgatgcgcagctggagacctatgtgaaccgcgcactgagtgaggcgaaagccgacaccgtggtgtcggggcgtcttccctccccgttgctcatcgacaagttcctgcaggacgccatcgaaatcgacgtcgatgcgctgttcgatggcgaggaactgtatatcggcggcatcatggaacacattgaggaggcgggcgtccattccggcgacgctgcctgtacattgccgccgagcacgctgagcgacgaccagattcgacgtctgcgcgaggcgaccctggccatagccaagggttgccaggtacgcggtctcatgaatgtgcagtatgccttcatggccaacacgttgtatgtgatcgaggcgaatccacgcgcttcgcgcaccgtgccgttcgcatccaaggccaccggcgtggctctggcgaaggccgcggcccgcatcatggcaggcgaaacgattgagcagcagcgtgagaacggcttgttgctgccttatggcgatggcggcgatgtgcgcctcggccagcaggtcgccgtgaaggaatcggtgctgccgttcaagcgcttccgcacgccggtcggcaagaccgtcgacattctgcttgggcccgagatgcgttccaccggcgaggtgatgggattcgaccgcgatttcccgcatgctttcgccaagagccagctggcctcctacgaggggggactgccgacgaacggcaacgtgttcatctcggtgaacgacaccgacaagcgtcagctgccgttgttcgccgtgcgtctggtggagcttgggttcgagatctgggccaccgagggcaccgcatcggtgctgcgccgctacggcatcgaatcgaagatcgtcgacaagattcacagccgggtggacaccgatccggagcatccgattgaaatccagcatgccgcgggtagcgttggcaagaacgtcgtcgagctcatcgaggaaggccagatcgatctcatcctcaacacgccgaactcccgtggctcccgatccgacggctattcgatccgtgccgcggccattgccgccgacattccgcagtacacaacgatgacggagttctccgcggtgctgttggccatcgaagccgtgaagaagaacgactacgaggtgatgagcattcaggagcactcccgtgagctctacgaactcgaacgcaagcacaaggaagaaggagaggaagcgcgggcgcaatgacacaatcgctcacagacaaggaacgcgaggccatgcactccgacttcggattgcggctgagcaactcaatgaagcaatacgggccgctatgcgtgggcattgacccgcataggggcgtgctcgagaactgggggtacagcgtcgacgccgaaggcgcggagctcttcgccatgcgtatgcttcaggcggccagcggcagggccgcagccgtcaagttccagctctccatgttcgaacgctacggctcccgcggtttcgtggcgctggaacgcgccctgtacgcggcccgccagatggagctcatcaccattgtcgactgtctgcatggcggcttgtcgaccaccatctcggccattgccgacgcctatttcaagccagatgcgcccatgcttgccgatgcgatcacgttgttgccatactacggtgcgcggtcgctcggtggtgtgatcaacgatgcgcttgacaatgggaggggagtcttcatcgcctcgctcacgtcgaacccggagggcgcgagtctgcagaccgcaatccgccagaatggcgagtacaaaggcaagacggtggcctatggcatcgccgcgaccgctcagaagtacaataaatcagtgaagggcctcggttcggtcggactcatcattggcgcgaccatcagccaatggctgcaggaaagcggcatcgaaccgggcgatttcacggggccgatcctctcgccgggctacggttggcaaggtgcggagggcagcgatctgaagaacgtgttccatggcaccaacggcaatgtgttggtgacggtgtcccgcgcgatttcgcaaagcgggcccgacatggacgcgctcatcgaaagcacccagaccattgccgccgatgtacgcaaggcattgcgcgaagccatcgacggcacgtcgacggcgccacgcggacacatggcgaatccgaaaggattgcgcacttgggaggaacaatgagcgaacaatcccggcaatcgcaggcaaccgagcggcaaggcggccggctgatcgtactcaccggccccacagccgtgggcaagggcaccgtcgagacggcgttacgcaaggcgcatccggaggtctgggtttcggtctccgccaccacgcgcgatccacggccgggggaacgcgatggcgtgaactactggttcataagcgaacccgaattcctgcgcaggcaggaggcgggggagttcctcgaaaccgccgtcgttcatggcatggcgcactacggcacgccgttggaacccgtacgtgagcacttggcagggaacgtgccgacaatcctcgagatcgacctgcagggtgcgcgccgcgtcaaggagcgcgcgaaggaactcggactcgacgtggtttacgtgttcatcgcgccaccaagcttcgacgagctcaagaaacgtctgatcgggcgtgggacggagacgcctgaacagcaggcgaagcggctcgagaccgcgaaggtggagctggcggcggagcccgagttcgatgtgacgatcgtgaacgagcaggtggacaaagcggcacgggacctgtggaatgtcatcgcacaggaatacggcttgccacaggataccgactgacggcatgcggcatcgaatgcgagtgggggtgccaccgaggaaatcggtggcacccccactcgcataggttctaggtatcgaggattcccagccgaatcaggccagtcccgaaagacggtcgatgagctcggggtcgcgggtggcgcccttgtcggccgacctggcgaaggcggcgaaggccttgagtgcttggctcactttgcgatcacggtgtgcgacatagccatcgccggcctcgagtttggcacggcgctcggcgagttcctcgtcggtcagctcgacgttgatcgtgcggttcgggatgtcgatggtgatgatgtcgccgttctcgacgagcgcgatgttgccgccgctcgccgcctcaggcgccacatggccgatcgacaggcccgaggagccgcccgaatagcggccgtcggtgatcagtgcgacgtccttgcctatgcccttgcctttgacgaacgaggtcgggtagagcatctcctgcatgcccgggccgcccttcggtccctcataacggatgatgagtgcctgacctggtttcagcgtgtcgttgagaatgacctcgaccgcctgctcctgcgattcgacgacgagcgcgggaccacggaacttccagatctccttcggcacacctgcggtcttcaccacggcgccatccggggcgaggttgccgcgcaacacggcgagaccgccttcggtcacggcgggatggtcgatgtcgtggatcgcgccgttcacacggtcggtgtcaagcgaatcgaatttcgtctcatgggtccatggctcgggggagacgatgtggcccggagccgccctgtagaagtccttggcgtattcggtgcaggagtcgcgcatgatgtcccactcgtcgagcttggcctcgagcgaggggtagtcgatcgaatgcacatcgcggtggagcttgccggcacggtcgagctcacccaggattccggtgatgcctccggctcggtgcacgtcggagatctcccattcgccggatggcgatgccttgcagatgcacggcacagtatgcgagatgcgttcgatgtcattgagtgtgaagtcgacgtccgcagactgtgccatcgcgagaatgtgcagcacggtgttcgtcgagccgcccatcgccacatccatcgtcatggcgttctcgaaggcgtgcttcgtggcgatcgaacgggggagcacggattcgtcgtcatgctggtagtactggttggcgatcttgaccacctgttgtgccgcccgttcgaacagctgcttgcggtagccgtgcgaggcgagcaccgtgccgttgccgggcagtgcaaggccgatcgcctccgtgaggcagttcatcgagttcgcggtgaacatgccggcgcatgagccgcatgtcgggcacacggtgcgctcgaaggcgaggaggtcgtcgtcgctcatggagtcgtcggcagaggcgtacatgacgtcgatgagatcggtgttctccttcacggtgccgtccggcagcacggtggtgccggcttccatggggccgccggagacgaacacggtcggaatgttgagacgcaatgccgccatgagcatgcccggtgtgatcttgtcgcagttcgagatgcagatcagcgcgtccgcacaatgcgcgttcacctggtattccaccgtatcggcgatgatctcgcggctaggcagggagtacagcatgccggtgtgccccatggcgatgccgtcgtcgacggccatcgtgttgaactcacgcgggatgccgccggccttcttcacggcctcggagacgagacgcccaactttgttgagatgtacgtgcccggggacgaattcgtcgaaggagttggcaatggcgacgatcggcttgccgaaatccttgctgtcaacgccggccgcacggtagagcgcgcgggcaccggcgaacattcgtccgttcatgatttttgcagatcgcatttccataagcatctattcaactcgaacttcgcggagagtgggcaaggcttccgcatgctggaattttcggccataatctcaacagaataggtacatctgtcagagtttgcctattttcgtcgacttgaggtatactgaacctttgcataagcatttgctagtgatttggagatttcaaatggcattcggcactgagcctatcccgaccggtcttgcggatccgccgatcgacgacctcatggagcatgcggattccaagtacgcattggccattttcgctgccaagcgtgctcgccagatcaattcctacttcacgcagctcaatgagggtctgctgcagaacgtcggtccgctcgtcgagtacaagagccaggagaagccgttgtcgatcgcgttccgcgagatcaacgaaggcctgcttgaggagacgctcggcgaagacgatctgagcgaaggaaactagactttcacgaacatgcatgtgcgccctgccggatattggtggggcgtttttgttttggcggccaacccggtttgaccgcgaatccaggtggtgctaagttacgcttgcgtatgaaagtagcgaagatgtgattgaattgtggagacaaacgcccgcatattgaaatagagaggaggagtcatggcagaagtgaagctgatctccgcggaatccgttaccgaaggacatcccgacaagatctgtgatcagatttccgacgccattctcgacgacatgctccgccaggacccgcattcacatgtggcggtggagacatccgccacgaagggccagttctgggtgttcggcgaagtgacgagcaaagggtactccgacatccagagcattgtgcgcgacacagtgcgtaggatcgggtacaccagctcggtgattggtctggatgcggattcctgtggcgttcttgtttcactgagcgaacaaagccctgaaatcaaccaaggtgtttcccggatcgactcggaccgggagaacgccgtctcgcgcgaggagcgctacgaggcacaaggagcgggcgaccagggtgtcatgttcggttatgcaagcgacgaaaccgatgtgctcatgccattgccgatccatctggcacatcgcctggcatatcggctcgcagaggtgcgtaagaacggcgaggtgaagttcctgcgccccgacggcaagacgcaggtaaccattgaatacgacgaggagaacaggccgctgcgcgtcgataccgtgctcatctccacacagcatgatcccgaggtctcgcaggaggcattgcgcgaggatctgcgggagcatgtgatcgagccggtgctcgatgaggtgctgggggatgcggtgaagcacgacgactaccgcgtgctcgtcaatccgacaggttcgttcatcatgggcggtccggcagcggatgcagggctgaccggtcgcaagatcatcgtcgacacctatggcggtgcggcccatcatggcggcggcgcgttctcgggcaaggatccgagcaaggtggatcgttccgcggcctatgccgcacgttgggtcgccaagaacatcgtggccgcgggtttggcccataaggtcgaggtgcaggttgcctacgccatcggcgtggccgagccggtgagcatcaatgtggagacctacggcaccgaggcggacggcgtgacccgcgagcagattcaggaagccgtgcgcaaggtgttcgatctgcgtcctgccgcgattgtggacgagctcgacctgctgcgtccgatctactcgaagacggctgcgtacggccacttcggacgtgaggacgatgacttcacttgggagcacaccaacaaggtcgatgagctcaagcgggccatcgccaccctcgtcgactgatacgaataccaccaagtccatcccggcaagctgcttatgcaggatgggcaacggcatatctcaatgcaacagctgcaccgaatgcgccgtgcagcaaggaatctccaaaggagatgaatatggccgcaatgaccgtggcacagatgatcgagctgttcctcaagccgggtgcacctgtgcatattgaaagtttcgatgggtcgtcgtatgggtccgacgatgctccgctgacgttgcaggtgaagaactcgcgcgccatctactacatggtgaatgcgccgagcgagctcggcctggcccgcgcctacctgcagggggacatcgattcgccgcagctcgtgcccggcaatccatatgcgctgttcaaggaactcgtaccgctcaagtcgtacctgcgtacaccaaatccagcccaactggccaaggcgctcgcttcggtggcctcccatgggttccaccgtcccgcgcctcccgatatcgagggcccaagccgtgcccgccgcatcagcgaaggactgctgccgcattcgaaggccggcgacgaggccacggtgagctaccattacgatcagtcgaacgaattctattcgatgttcctgggaccatccatgacctacacctgcgcggtgttcgactccccgctcatgtcgctcgaggccgcgcagaagaacaagatcgacctcgtgctcgacaagctcgcactccagccgggagaacgactgctcgacataggttgcggttgggggtccatggtgatcgaagctgccaagcgcggcatcaaggccctcggcgtcacgctgagcgaggagcaggtcgaatgggctcagcgctggatcaaagacgaaggactggaggacctcgccgaggtgcgactcatggactatcgtgacgttcccgaaggcgatttcgacggcatctgctccatcggcatgatggagcatgtcgggcacaagcactacccgtcgtatttcaaggagatctacgccaagctcaagccgggcgccaaattgctcaaccaccagatcacccggtgcaactcgcatcagggcaagaaagccggtcagttcatcgaccgttacatattcccggacggcgagctctcctcaccggccgagatcgagatggtgatccaagacacgggcttcgaggtgatcaatcaggagaacctccgccagcactatgcactcacgctgcaccgttggaacgagaatctggtggcgcattgggatgacgccgtcaagctcgtcggtgagccgaaggcccgtttgtgggggctctatatggccggttgcgcgttcaatttcgagatgaacaacattcaggtgcatcagttcctcgccatcaaaccaaacgatgagggcactgacacctacccgttgcgtccatggtggccgaaccactgagtcggtaagctgacgcccacgtggaaagcggcatgctcatacgcatgccgctttttcgtatgtatggagctggacacgcgcatgctgacgcctttacctgaatgaggggagagcctagactggggcactatgagtggaacacccgaagaagcgatgcagccggctttcgacggcatgggcatgcggcggcgctcgccgcgcaaggcagcgcccagaaagcctgctgcccagctgccggtggcgcgggtggtgctggatgtgcaggccacgcatctggggcagcccttcgactatttcgtcgacgacagcatgagcgaagccgctcagccgggtgttctggtccgggtcagattcggaggccagcgcgtcagcggcattatttgggaacgggtgaacgacagcgatacgccgacaaatgccattcgctacatcgagaaggtcgtttcgccgcgcgtgctcgtaccgagccagatgcgccgtgacatcaccgccgtggccaatgcctacggcggcaccatagcgaacgtgctgcgcgtggccatgccgggcagggtcgccggcgtggagaaggagcccaatgccaccatgcaatcggcaagcgacgtggagtcggctgccgatgaggcgtcctatgccgattcgccgatggttgatcgcaggggtcgtttcgcctcacgtgccgaagaccatttccccgtgatcgccaaagcctatgagcaggcacagaccctacgtgcctcactcaccgcaccgcaggggttctcggcgttcgtcatcgatgcccttccgggggtcggtgcatgggaacggacactggcctggatggcgctcaccgccatgggggcggggaaatccgccgtgctggtgatgcccggcatgcgtgaggtgtggagcatggtgcatgcgctggagaacatgggactccatgtgtttgcgccaaatgccaggcagatatacgagggtgacatcgcggtgttgagtgcagcgctctcgccggccgacagataccgggcgtatctggcgattggcgaggggcgggtcacttgcgtggtgggtacgagggcggccatgtatgcgcccgtaccggacgaggcgctgtttgcgattgtggacgacgacgcctaccagtatgcggatggcctcatgccctatgcgaatgcgcgtggtgtgtgccgtctgcgtgccaagctccatggaggcgtcttcgtcgcaatcggaagggcgcgtagcgtgttgagtgaatgggaaagccaaacctcctcggtcgtgtcggaggtcgctggtccgagtgtggcggtgcacggcttttccgatgtgattaaaagccaggcaccgccggtacggtggctgaaccgtgacgaactcaaccggctcgccgatcccagcgtcggtgccagggtaccgcacactgcggtgcgtgtgctgtcgaaggcgcttgagcatggccccatgctgttctccataccgcacgatggcgtcaccgagtcgttgagttgcgcgcagtgcctgcaactggctcgatgcctgcgttgcagcgggccattggtgcgtattcccggggccgatgccccgcgatgcagctggtgtggcgcatcagcagtggactggcattgcaggcattgcggagcagagcggttgcgcgtgatccgtgtgggggcggtgggaaccgtgcaggaattgcagggcctattccgtggcgttcccatgctcgtgtcgagccaaagccaaggggttgtggatcatgtggatgccgccccgcgcattgtcgtcgccactcccggatgcgaacccatggtgcatacgcaagatggtacgacgggagcctacgaggcggtggcgattctcgatgcctggacgagtctgtacgatctgcgtctcgatgctcgcgtggatgtgctgtccaattggatgcaggcgatgtcgctgtgcaaatcacgtgccgccggaggcaggggactgctgatcggcgagacgtatccgactctggctcgttcgctcatgctctgggatccccgcgtggttgcgagcaatgagctcgcggaccgcattgcgacggggctgcccccaatcgtcagtgccgcctgcatttgggggagacgtgatgcggtggaacgtgccctgcacaacataggcattgcgaacggagattgggcatgggtggaaagcggagaagggaaggtcccctcactgctcggcatcacccctctcgctccagatcgcacgatcgatgcccgtgaactcgatgagatgggcgatagggtgaaggcggtcgtgcgcgtctcgcatgcccgacgtgccgaactcgcattgcggctgcgcactgaggtggcgcgtcacgtggcctctcgcgaaagtggggaactgcggttcagaatggacccgaaagatctgctgtgaggcggcatccgactcagctgtgaccgtaagccgactgcctgcgccttgtgcgtactatgcttgggattcagtgaaaaccacagcccatgagttgcacgggcggaagagaggacatcaatgttacgagtgctgttcgcgggaaccccggaggtggcggttccctctttgcgtatgttggccaaagacaccgagcatttcgaagtggtcgcagtgctcacccggcctgacgcgcccacggggcgcggccgtaagattatgcccagcccggtgaaaatggccgctcgtgaacttggcctcgatgtcatcgaatgcgatccggccgacgaatgcttcctctccgcattgaaggccaccggagcacaatgtgcggcggtggtggcctacggcaagatcctgcgtgaatcggtgctggaggcgctgccgctgggatggtacaacctgcatttctcgctgctgccgcagtggcgtggtgccgctccggttcagcgcgcgatctgggctggcgacgaagtgaccggatgctcggtgttccgcatcactgcaggtatggatcgtgggccggtgctcgggcagagcacggtgaccataggtgcgcatgagaatgccggcgagctgctcgaccgtctcgccgaagatggcgccggtctgcttgcggcatcgctgcaggcccttgacgaaggagtcgtcaacgccgtcgatcagccggcaggctcctacgatgtcgccgccaagatcaccacgcaggatgcccacatgcgtttcgacgtgccggctttcgcgcttgatcgccagattcgcgcctgcacgccggcgccgggggcatgggcgaatctacatccacatggtgatgatgccaacgagacgctgcatgtgtcgaaggccatcccggccgatatgacggccgatgaatcacctcggaatctcaagccgggtgagctgcacgtcaccaagcatcacgtgtgggtgggcacttccaccgacccgttggaactgctggttgtcaaggccgcgggcaagcgagagatgggggctccggagtgggcccgcggcgcacatctggctgaaggtgcctatctcgactgacgtgtctcaccagaatgcccggagccggctttcatcgaggtgccgactccgggcattctagtgaattgctgcggttgcccggcagcggacattgttctgctactgcaggaaatcaagcaccttgcgaagatcgcgctcgtcgatcgtgtggggggccgccgtgcgcacagtgggtttggcgcagaatgcgatgcccagtccggcagcgccgatcatgggcagatcgttcgcgccatcgcccacggcaaccgtctggatgcgcgcgatgtcgttctcttgagcccatgaccgtagccgggagagtttgacctccttggtcacgacatcaccgaccacttcgccggtgagcatgccgcggcgggcatccacgcccagtcggttcgcaatgtggtaatcgagatgcgcgtctgctgcgagcctgtcgacgatttcgtggaagccacctgagacgacccccaccttccagccatgcgcatggagcgtgtcgatgagttcatgtgcgccattggtgaaatgcaaccgttcgtacacgcgatcgaagatctgtgctggcatccctctcagcagcgccacccgttcgtccaatgcctgccggaaatcaagctcgccgttcatcgcccgcgcggtgatggccgcgatctcgtcgcccacacccacctcctcgccgagttcgtcgatcacctcttcatcgatgagcgtggaatcgacatccatcacaagcaggcccggcatgccgagagcgggtaatgggtcagcgagtgtgtcggtgttgtcaagatgttgcgaaagtggtgcgctcatgcctttgattgtcgaaaaacgttgggacaatcaaagcatgcactttactgttaccctggctgaggcccaactgcaatgcgccacgagttccgatggcctgatcggcgccatgacggcgtggctcgtctctctcatggaacatgtgggcggtgtgggcgtggcattggccatcgccctcgagtcaatcttccctcccattcccagcgagatcattctgcccctcgccggtttcaccgctgcccgtggcagcatgagcctgttcggtgcgatcctatgggcgacaatgggatcgctgctcggcgcctgggcgctgtacggcattgcgcgctggttcggtctccaccgcattcacaaggcagtcgacaggatccccggcgtgagccgcaaggatgtgaacaaggcaaacgaatggttcaacaagtacggcacctggtcggtgctcatcggacgcgtgattcccgttgttcgctcgctcatctcgattccggccggattcaaccagatgaacttcgcgaagttctccggctggaccttcctcggctcggcaatctggaacacggtgctcgtcaccgccggttacatgctcggcgaccagtggtgctccattctcggcgtgctcaatgtgttcgaagatgtgatcatcgtggtgtttgcgctgatgctggtgttctttgcgtggcggtgggttcgcaatctgatacgcgaacgtcgctcgacgcaatcccatgagtagactgtcgatgcgcgttaggcgctgaagtcagttcgggttcgtgctctcctgcacggacccgttttcctttgcggggccgtgcattacaatggcatacggaacattcggattgaacgaaggtgggtatggggcaggagaagcacacggacgcggcttcgcagtccagggatcccgaggctgtggcggcgcatgagaacgaccagctgcggcagcgcaaccacgcgctcgccaaagcgctcacccgtgccaccgaggagcttcgcaaggcgaaggcgcagctcgagcagttcatggcaccgccattgacaatggcgaccatggtccgcgtgcatcgctgttccaccgatgagcatggtgtgcggcatgcaagcgcggagattctcaatggcaacagacgccagatcgtcccgctgtcgccgactgtcaatcccgcacagttggggagcggccaaggcgtgttgctcgatgccaacatggtgattgtcgattcctgcgagacacctactaccggtccgatgcgtgcggtctcggaaagccttgccgacggtaggctcatcgtctccgatgtcggaggcaatcgcggtgtggtcatgcgtgcgagcgcggtggcacgaactccgatcaacgtcgacgatcgtgtggtgatcgatccctccggtacctatgttttgtctgtactgccgcaggaacaggcgcaggatctgcttctcgaggagactccggatgtctccttcaccgacatcggaggtctggatgagcagatcgcacggattcgcgatgccgtgcagttgccgttccagcatcgtgacctcttcgaccggttcgacctgaaggcaccgaagggcgtgttactgtatgggcctccgggcaatggcaagacgctcatagccaaggccatcgcgcatgagctggccgcgggcagtggtaacgacggcgtgttcctgtcggtgaagggaccggagctgctcaacaagttcgtaggcgagtctgagcgcctcatccgcagaatcttcgagcgggcgaaggagctgtcgggtgccggacgccccgtcatcgtgttcatcgacgagatggattcgctgctgcgcacccgaggcacgggcgtctccagcgatgtggagacgacaatcgtgccgcagttcctcaccgagctcgacggcgtggagagccttgacgacgtgatggtgatcggcgcctcgaaccgcatcgacatgatcgatcccgcggtgttgcgtccgggccgtctggacgtcaagattcatgtcacacggccggacgagacggccgccatggccatcacccgtcattacctcaccgatgcgctgccccttgaacccggcagggacgcggatgcgctggcggcctcgctggtgcgtgatcttttccgcagggatgaatcccgattgcttgccacgctcgatgaacagggccgtcggcgtggaatctacatggccgacatcgtcagcggtgcgatgctgcgcaacatcgtcgaccgggcgaagaccaaggcggtgaaggccgaaatcctccatgggtcggtgagcagggacgatgagccgcaaggcatcaccgaggcgcggatccatgaggccattgacgacgaatacgaacagaaccgctccacgatcaacgagacagatccagggcaatggctcagaatcaacgcgctgacgttggcggctgacggcgtctgatcccggcagcgggtctcggtggaatggaatgtgttcgaaatgtgccgttggcatggaacatgtcgtgagaggagcggagtgaatgagcgtgcgcagagtgatggggacggagaccgagtatgccgtgtcggtacggcaggatccccatgccaacccggtgcagtcgtcattcgatgtgattgcccatgcaggcgatgaggagacgaggcatattcgttgggactaccggcaggaggatccggtgcacgatatgcggggtatgacgatgccccgcgccgctgcacgtcccgacatgcttaccgacgaaccgcaacgcaatatcacgaacaccttcgcagccaatggagggcgcatgtacgtggatcatgcgcatcccgaatactccgcgccggagacgcgcgatccgtttgaggccgtggcctatgatttcgccggcgatctgcttatgcgtcaggccgcccaatccgcgagcactgagcggcatcagttcgaggtattccgcaacaatgcggatggcaagggcgctgcgtgggggagccatgagaattatctgctgcgtcgcgatgtggacttcgatgtagtgactgcgctcatgctggtccatttcgccacgcggcagatctacacgggctctggacgtgtggggctcggcgagcgcggggaacgggcaggctaccagttgagtcagcgtgccgattacttccatatgaaagtgggtttgcaaaccactttcgacaggccgatcgtgaacacccgcgacgagtcgcatgcgcctgacgagatgcgcagactccatgtgatcgtgggcgatgccaaccgcctggaagtgccggacgtgttgaagctcggcacgacaagcatgctgctttgggtggccgagcaggcatctgcattggattacgacctgacggatgagttgcgttccctttcgcttctcgactcggtcgccgccatgcacacggtgtcgcacgacctgaccttcgacgaaccactcgctttggccaatggaggttcgagcacggcgtggcagctgcaggtgtcgctgcggggccttgtttacgaggtggcatcgatggtgtacggcaccgattcgctcggggagccggtatggccggattcgcagacccgctcggtcatggcgatgtggcagcaggcgctgatcgacgtggccgaggttcgccatgccgacgacgacacccgaatgacgatgaccgcgcaggcctctcgactggaatggcttctcaaatggcagctgctcgaacgcatgcgccgacgcatcgccggttgcggcgcatcctctgcttcgggctgggacaatccacaggtgcgcgcgctcgaattgcgatgggcttcgctcgctcccgagaacgaggcggtgttcgccaaggtgcgctcccgtgccgagcgtgtggtgacggatgagcgtatagccgcggcggcgaccgatgccccggcggacacacgcgcatggttccgtgccgcgatactgcacagattccccactgaattgcgtgcgatctcctggacccgaatcaccaccgttgccgatggagccggtgattcctggacgctcgacatgcgcgatcccacgcggttcaccaaagatgacaccgaacggcaggtggaggaggcgtccagcgcggcgcagctcatcaggagtctcggcggcatctgcgaacattcgtaggtcgtacatccgctgtatccagcgcgctcgcatagggcgagtttttcagaatactcacagattatttgctagtcttggaacagatttttccgagacataaggtcacaggaggcattggtatgcaggccggattacgggagctcgcagtgcaggtgagtcgcatcgccgaggacgccggcaagcatgcgctcaaggaccagctcatgccgaaggatctggtgacgctgaacacggtgcagcgtgactactcacgcgggctcaaggtggacgaccgtctgtcgcagttcatctacaatcgtctcacctacatcgatccgttcaaaggccgttgggaggatcgcaccgacgaatgggcgcccggtgaccggtactggtgcgtgggcggtgtcgatggcgtgatcaactattcgcgcagcatggccgaatggagcgtgaccatctcgctgttcgaattcaatgagttcggatcggcccagccgattctgggggtgattcatgcgccggcactgaacctcacctatttggccgcccggcagcagggcgcgatccgcatgcgcaagacaccagtgggggagaagcgcgagaagatcatgccatccacagtcagccacctcgatggctcaatcgtgagcttcggcatgtcgtatgtgccgcaggaggcacaacatgccctcaatgtggtcgcgagcctcgccggcaagcccgccgacatcaaacggatcgggcccgtctcgctcgatgtgtgcaaggtggccgatggcacctacgacgcgtacttcgaaccgcatctgcatgaacgtgatgtgccggccatctcggccgccgccgtggtgctctgggaggcccaagggcagctgagcacatgggagggcgggctcatccactggcgtagccagaacgatctcgtggccaccaacggacagatcatacaggagctgcaaccctacctcatcaactctgattgtggggaatcctaccatcatcacgaacagaagcccgcgggacaacagtgatttcaaatcctgagccactttgaacagcccatgtggcacagggcacatccgacatcgatattggaatccacaccagattgggggagcaatgccatctgcatccggacaccatcagatccccgccgagacacagcggcatgatgacgaccagacccaggaaacggcccagggtctttccgcagcggccatgcttgcgcaggagcaggctgacgatctcgatgcgattctcgatgacatcgaaaccgttctcgagacgaacgctgaggaatatgtgagcagcttcgtgcagaaaggcggcgagtgatgccacagctgcacgacagtggcagcagggcgatacagccgtcggaccagacgcatcagcatgatttcgcgcgcatcttcggcatcgagaccgagtatggtgtgagcgtcaccgatattccggagcccatggacgccagtcatgtggcgatgacgatgttccagcccgttgtgcgcagggcccgttccaccaacacctacgtggagaacggctcacgtctgtacctcgatgtgggatcccacccggagtatgcgaccgccgaggcgatatgcccctcggatgcgttgctgagcgatctggcaggcgagcagaccatgcgttcgatggggcttgacgcccagcggaggctgcgggaatccgacgcgcagaatcggcatgcgaccctgcatctgtacaagaacaacgccgacagtgccggtcattcattcggttgccacgagaactacctcgtgcgccgtttcgtgaatctggacatgatacagcatgtgttgctgccattcctcatcacccggcagatctacaccggagccggcagattcgacggagaacggctcctgttcacccaacgtgcggcattcgtggacgagaccgtctccagcgccaccacacggtcgcgcccgatgatcaacacccgtgacgagccgcacgccaaccccgacgactaccggcgtctccatgtgatcataggcgactccaatcgctcccagtgggccacccttatgaaatgcgccaccacgcatctcgttctgtgcatgatggagcatgcagcgcgcagcggctgcgagaccgagcttgaggcattcgcgctcgcggatccgatcgctgcaaaccacgccatcaacaccgatggggcgcatgcccgcatcgcgctggcagcggggcgttcgaccaccgcactggaactgcagcagatgatgctggagcaggtcgagtccttcgccgcacatcacggtgatgcattggaggcatcgttgcggtatgacgcgttgtgcaatgtcgaatggattgtgggccaatggcgatgggtactcgacagattggcggccaatgacatcgagacgctgtcgcacgtggtcgattgggcatccaagcaggtgttcttcaatcgtttgcagtctcggggcaccgtcacaccggccagattgcgccagctcgacctggactatcacgacatcgccaacggcaggctctacccgtcgttatgcgcgcatggcttgatgcgcaccttggtggatgccgatcagattcacgatgccgtgtccactccgccccctcacacgcgtgccgtgctgcgtggacgtttcgtggcggcggcatcgcacaccgatgccgtctacgactgcgattggacgacgctgaagcttgtgcgtccggtgcatatggaggcggtgctgctcgatccgttccatgacgagccgaccaagcaatatgacaagctcatgggcgaattgggtgatgcgcgcgcggatggcgatgaagcgcccgtctgagcatgggtgccgaagcaatctgacatgaaaaaacccggccgtcactggccgggtcattttctagcgtaggctgcgaatcactcgctcactgccttcttcagcagggagccagcggagatgcgaacaccataggtggccgggatctcaatggtctcaccggtacggggattgcggcctgtgcgggcggcgcgcttgacgcgctctgcggagagcagaccggtgagcttgaggccttcgccgttcttcatggcttcgatgaagacatcgcggaaagcattgacggcagcctcagcctgagccttggtgagaccggacttctgggagatctttgcaacgagatcagacttattgtatgccatagaagcgtccttctttgtcaggggtaatcctcattgcggataaccacatgttcaagaagcatcttacctcaagattcggtcaaatccgcgtgtttgcaacgatttcccttgattttttcgcatttggctacgttctgggcatcaaaagcttacaaaatgaaataaatcagatcagattgtgcttatccagccacttcatagccaacgcacccagcggaatacgcaaccagtagaacacgacacgatagagcaatgtggctgataacgccaatgcggcggggaccccgacggcgctgaacgccaccgacagcgcggcctcgacggcaccgaggccacccggtgtgggcaccgctgaaccaagtgtattcgccagcaggaagatgaacgtcgtctcgatggggttcatgttgaatccgaacgccatgagcgccgcccagaagccgaagcctgtggagagattcagaatgagtgagccggccaccgaaccgagcagcttacgcggctgcgtgagcgtttccaacaacgatctggcatatgacttcaccaggggaagatacttgttggcgatcttcctgcgcaccgaggggatcgccatgatcacgctgatcgccagggcgacgaccgcgatagcgataatcagcgtgttcgtgggaatcatgccggaaagggtgttacggccggtgaaaatgccaatgagcagcagcaggaccaccgtgatcaccccctgcacggcgagcacggcgctcatgatggcagtggcggtcgtattgcggtagccgctcttgcgcaggtactggaggttcacaaaggccgggccgatgccggcaggcatcgacaccgcagtgaatccggcggcaatctgcgagcagagcaaaccgaaaggccggcggcggtccctgtccatgaaggcgccgagggccatggccgaacccacccatgcgaggaagccgaacagcatgacaacgaatgcccaccagagattcgcctgcttcacggcgcgaatcatctcgtccggccgcatctgcgtcagcatcacgtagacggcgatcaccagcaacacaagaccgaagaacgatcgcgcattgaatcgcgtgagcgtcacctgctccatcgattccgccacttcttcaggggccagtttactgagtgcggtgcgcagatcctcgacaatctgcttgttccagccttccatctgccgggtggcggcagggacggcggccttctgaacaaacggaatcaacgagatgagtgtcgattcgccccaggcacggcgcgcgagcgagacggtgcgttcaatgccgagcatcgtgctgaacaaggtgagcagctgtactttgtcgagtgtgatgttcgtggtggtggacgcgtaatcgccattctgccagccggcaatcaccatgtcgccaatggcggagcgcgcaatggtgtccgccgtgatctggcggtgagtgaagccacgctgatgcgcacgctgcagatagttcatgagcgagagcgcttcggtatcgtcgagctccctgcaatccacggcgtgaatggtctcgcggtgctcgaacacgactatagaggattcaccgtagtcgcagacaccatagggccttgcacaggtcagatctatgtcacgcagccccagcagcatggaatagtggtggtgcgtggcgctcacggcggagcgatcatggcgcaccgcgacgccgttgagccgaatgagctgccacagctgtgagaaatagccggtgatctgcacttggttgtcaagcaccgacaccacatagtgcacgccgctctcatcagtcagatcgtagagtcgggaatggtcggtcaggtcgtccgtaagcatgggtgcatggtcggatgcctcggggcgtcggtcaaggacggccggatgcaagccgatggagctcagcgcctgcacgatctgatatccccatgctcccgagttcttcgtgcccacgccgaaacggatggacagtcccaccatgcgaccgatgcaaatggccaccagcacaccaggcaacgagctccacgaggtcatgatgaagatcacggcgccggcgaggagtatattccagctccacttcaccgatgaccgggtgtcacggggacctgcgaccgtgaggaatgcagctatggcggcgtagaaatcgggcagcagggaaggccctacgcgggtgccgctcgacagcaatgtgttgatgagcatggcgctgctgtggtaggagagcagttcggagacaccccagcagacaaggaagccgatgagcagcgcgccgaccgagcaagcggactgaagccattcccggttgagcaccaattggatgagcacccctaccacgatggaaatcacaatgagctgttgtagcaacgacgatggcaggtcgaccagccagtcgaatgcctgactggcggaatgggcgtcatcttcgacgccggtggtgagcccatgaaggtagacggcgaccaggatcaccagaatcccgaatacgagagccgcacctgcgtgcagcagatcgctggtcacgtggttgcgcttcggtgccacatcgctgaccttcacgttggggaacctacttgccagtgcatgctcgggggtcttctcgatggacggttgttgcacatccgtctgatcggagggcacccgacctgagccggacgaattgggcgttgtcatatcagtccttcatatagaatgcccatgcccgggtggaaggcccaagcatgagcatcgcacatcagcacgtatattctacgcgatggattgaaaaaggactacgggcgatcgtaaccgaccagcatcgatgcaaggcccacataggtggccggcgtcaaagccttgagacgggctgcggtctcgtcgtcgaagtcaagcgaatcgatgaagctctcgacatcggcctgcgagatggagtggccgcgcatgagctccttcaccttctcgtaggggcgttccatgccggagcggccggccagctcctgggcgcgcatggcggtctggattggctcgcccagcacctcccagttctcatcgagctcgcgatccatcacctgtgtgttcggatgaaccgacttgaggccaccgagcaggttgttgtgcgccagcaccgaataccccaatgctgagccgatgttgcgttgcgtggtggagtcggtcagatcgcgctgccaacgggactccacaagcgtggctgccaacgtgtcgagcagcgagcaggagatttcgaagttggcttccgcgttctcgaaacggatcgggttcaccttgtggggcatcgtggacgaaccggttgcgcccttcaccggtacctgggcgaacacgccacgggagatgtacatccatgtgtccacacacagattgtgcatgatgcgattggtgtgcgagatcgtgtcgaacagctccgcctgccagtcatgcgattcgatctgggtggtgagcgggttccaggtcaggcccatgcggttctccacgaattcacgtgagacggcgacccagtcgacattcggcaatgcggccagatgcgcaccgaaagtgccggtggcgccattgatcttgcccaggtattcctgctcacgaacatgcttgagctggcgcccaagccggtacacgtagacggcgagctccttgccgagtgtggtcggtgtggccggctgcccgtgcgtgagggagagcaacggcatgtccttgaactcctcggcacgctgagccagcaggtcgacaatggcatccgcgcccggtagccatacgtgttcgattgcattcttcacgcagcgggcgatggagaggttgttgatgtcctcgctggtgcaggcgaaatgcacgagagttttcaggtcggtgagctgggtgggggcaccgagcacctgctccgcgctatccagatagtcgtcgatgtagtattcgacagccttcacatcatggtgcgtaacggcttcatgcgcggcatgcctggcaatgccctgtgccccgaactcctcggggatggaacgcaggaatgcctgttcctgttcggtgagcggcttgacgccggtgacaatcggcttccagtcgtttccggcgaagccgttggcgagcagaatcatccattcgacttccacgcgcatgcgttcgcggttcagtgccggttcgctcaggtattccaccagagcggcggtctgggcatgatagcgcccatccagaggggtgagggcgatggctggtgagatctcggaaaggttcatggttccaccctaaaccaagcccttgagacatggacggtgtatgtccattttcactgcgtgtgcgtgtcatccatctcgatgtcgtgtttgccgtgttccatgcggccgctccagtaggtggtctccatatagtcgccgtgaatggtcgccatgaaatggctgtcatggttcgcaagcgcctcggaccccagcgacagcgcattctcataggcggcggtatggtaggcgaggtcgtgcgtgagttcgtatttcccctgatgggattgatcgacggcggtcatggcagcggtgccgtcatccacggcgccattcgcatcggcaggtgacccgtccgccacattgcgcacctcacctcgaatggtgagccactgctcgctccgaggattcacctcgccgtccagcgcggcaaccagttcgtcttccatctcaatgctggtcacccatgtccccttgcccatcggatggttggcgatgggggagccggcggtcacgatatgttcgatgcgatactcatcggcataatcgctggccagcgttgccgcgatgatgccgccctgcgaatggccgatcaacgccacgcgctcatcgcggccgatacccgcctgccgcatggcttcgacgaccatacgtgcgctgtctgcgttacgtcgttgcatggcattggcgctcatgagctccacattctgctcccatcccaagggggagtcgaagttgccgtcggttcccggaatggtcaccagccaggaacgccggccatcggcatccacataccgtgagatggcgatggttgcatattcaccatgcgtgctgtccgcgttcgctgccgagagccttcgcagattcgccagtgcaccgcccatgtccgacacaggggcgacggatggttcatggggatccacggattcgacggtcagcgcatcaccttgaatcagattcgttgctcgcgatgagattcccccgatggcatatgctcctgacggcaccggtgattgaccgtcatgcaggcctatggctgcgctggccgcacgcatcagcccctcctgctgccacgagatggcattcaaggcatgggctgctgagaaattgccctcagtgaccacaccgtatagccatccgcccagagcctgtgcaatggtgaatttcgccattgtcgcaggtgccacccgtgcggcccattgcagtgccctattagtggccatgcggcttttggcctcggcctcggaatacaggccgtatgcacgcgccaatacatcggcgattctctcgcattggacggccagcgcatgcagctgtgatctggcggattcagcgtggtccgtcaggcgaaggtactcgacatgaacatgaagggaacgaccgaatccactcgattcacagacgggagctcgcaatgccgccatgccgttctgttccggacaccattgaagagttgaggtgcgcagcacggcaacacgcattctggcgttcgacaaggcgatggcctgtgccttcaaatcggcggcgcaggcccccaaccgtgagcatatgccgtgaacgaggtcgagcgtggcagtggcatactgagcgccaccatgaatggatgatctcaccatcttcgtcatggcagcccctacattgtcgagagcaatccgtcgagcatctgcagcgtttgcatacatgcggatgctcgtggttccatggcctgcagccgttcatggaacaattcggcggcacggccgctccatgttcctgtatcggaccggcacgcggccatcaggccatcaagcgcatggaacgaaccgcgcaccaatggcacgagcaatgcgatgcattcctgtgcattgcccgcgcatacgcactgcgtcgtggtgcccgacgtggcgttgaacgctgaattggagccgatcatgattccattgcacaccgcagtcgaccatgaatccagctgaatcggcgattgtggtcagtgaacggcgtgaatgcattgactccggaaactatccacagtgcaacactgcatagccattcaccgtcgtggcttaccacggtttcacattcgacgggcgagaggggctgtcgttttccctctcgccttggccgccattcgattcgttcgtggaatcctcggatttgcccagctcctcgttgctgcgtagcaactcctccacttgcttgcgctgttcctcggtgagcgagtcgagtgatttgggctgctcgccgtgctgccccgactgctggctgtcgttcttcgcggcatcggcgtcgacctgttgttgcaccaagtcggtcagctgtttcgaaacctgcgcgttataagtggtgctctcgctgatctgcggcagcagcaccgccgattttccggtgatactggcgaatcgtgcgtccagctcctgctgtgaggtcagcagttgcttgagatcggcgtcgttgcgggacgcggtctcgagattctcggtgagcgtttgagtcgcggcatcatactgacgttgtgcgtcgatgttcacgccggccaatacggcgaatgcaatggccaggacggcgaatgccgcaagcatgatgcgcacgccgagaggcgcgcgtttcgtgaaagacctgctcgccgtggcgcgatccaggcgcccggatatgttcccgctcatagaagcctcctcgaagtggcgatccatgtgcccagctcccatgccagcaacgcagccaatgcaatggccagtggccagacaatcggattgatgcgcgtacgctccttctgcgtgtcgtcttcacgccagctcccggcctgttgcgcgatctgtgcgctcgccaccgtgtcgttcgccgaggtgatcaccactttgccactgagctcgtcggccagcgaccgaatctgtccttcatccatgatcgatacgccgggctggcccgtagagggatcggtgacccattgacctgcggtcttcgaaggtatccggccaccggtggtggagccgacgccgatcacgcaggcatcgtcaatatagtggcgcagcgacgaaaatgtgcggcgtgtgttccgcacagtctgttccccatccgtgatgatgtacaacacaatgcgatcgtccgggtgggcgtcgcgaatcgatttgagtgcacgcagcaacggatcgatcaccacatcaagcgatgaaccgctggaactcgaggaatcctcggtatcaagggactgcgcccaattcgtgatggcacgggtgtcgggcgtcagcggcacatccaccgctcccgatgctccaacggatactgcggagaaactcgaattcgggtaatccctgacgatgtctgcaatggcggacttcgccgcttcgaggcgggaaaggtcggacttggagccatagcgggcatcctgcacacccatcgacggcgtgatgtccgagacaatgaccacatcagtggtactgatggcacggctggtggtcttggtcaccatgcttggtgtgaaggccatgagcgccacgatgacgcatgccagcacacgccttacgcacgaccagagtgtctcatcggtaccatcggcgccgcgacgtgcatgcagcacgacacacgtcaccgcgcatgccaccatcaccgcagccacaagggagccgccaatccagccgagggccggtgcaaagccgaacgtactcatcgcttcaacctccacgccataaccaaccagcccgcaagcagaatcgccacagcgagagtccaccatcccgggacgtccgtcagggcagtctgtgattgggcctgtgcctcatgtgaacgacgaccgtctatctcacgcaccaattcatcgatcgacgcgctgttcgactgggtgaggaacagaccgccatgccgctcgatgagttggcgcatctcgttggtcgtggcgtcaccctcactggattgcggtcccgaatacagaccgtccacattgatgccggcttgggaggtgagatcaagcgcctgagccaacgaataggtgggggagcccgagaccacattgtcggtggccagcacaatcgacgcctcccgcgaccgagattgcgcagtgtcggccttcgaataggcgaatccgggaagcattgcggcacagcccaccaatccatctccgatgagtgaagtggcgttcttgcggttctgtgtgccctcaagccagtcggcaatctgctggtattgttcgtcgctcatcttatcgatatcgtcctgggtctgcacgcctttgagcatgtcgttcgcctgcgtgagttgctcggtcaccatcgcgtagtcatcggtgagcgggaacaccgtacgcgacgatgagttgaagatgctcaggcctatgcgctcacccttgaaatgctgcagcagattcaaatacgtggaaagtacctgatgatcgtagggaagcgtggatcctgagacgtcgagacacaggatgatgtcgcggttcgatgattgctcgtcctgtgcatccacatgcgcaggcctgcctacgagaatgcaggagaggacaagcgcacaagcgagcaatgccacggcgatgcggttcagacggcgccagacgcgcatcagcgcaccggcatgctcggtctcaagatcatcctgtacaccgtagattctcgcttcatcgtggtaggcgcgccgatgtgacgataccatgacgatcgtcaggcataccagggcggcgatcagcaatgcggccaccaatgcccacggccattgccaacgaagcatcattgccacctctcaatcaggtcgagcacccagtcggccgcctgcctcacgctgacgccacgcgcctgtggatgctcggcttgcgcgaactccggcggatacagcgcggcgatcgtctgtcggagcaaatcccagttgacggcgacgccggtgcggcgcagacggcgtagatcagtcaacgtgttcgcctgcatgcgtcgtcccgacatattcgatgcgaaatcgcgcgcaatcgcggccagctgcgcgaaggcctcgtctcgcgtgatgtcctgagcgtcatgccgagcgaccacctggttcacccgcgcggcccactccttcttgggaagagtctcttcatcttgcgatccggtggtttccgggcgacgtcgagtgcctgacagtacgcagcatgccacaatgaggatcaacgccagcacgatgtcgcagatcagtgcaatccagagcgattgcgtgatggcgatggttccgcgcggatggaggttctgggtgtctattgccacaatcatttatgcgttcgcagttccttcgggaatcgtgacgggcgtgaagaccgatgcatgggaaagggagagaagccgcacgaatgcgtggaacatcccctcgctcgacgaggcgtgaatcatacgtgatccacagcgcaacagttcccggtcaagcgcctgcaacaggtaggccctatgggtgtccaactcctgcgccgctttcgtgttgcgcaggaacgcgggaatcctccggtcggtcgcgccatcgacaagggatgcatgcggcctcgagggaatgggatcgctcgagaacgggttgatcgtgcccacattgatcagcaccagcggatgcgtctgtgtgatccgccggattgcgcgcatatgcgtgtcgtcgagggcatgatcgtcggtggcgagcacaatgagcgcctcacggtcgcgaatatgcgcggcatagtcgagcagtgcgtcgatattgcgcgggaatcgccagcctcggtcaagcgccttgtcgagtgtgtgctcgaactgggccaaaccgccatggaacggcacccgggtgatattcgaggagtcaccgaagacgagcgacacctcatcgctgcgtcgcaggctcagcgccgcgaacatgcacaaggcattcgctgcgatgcgatacgccatctcgtccgaagggcacacctcggtcatctccacgcctgcgtccagcaacaggtacacacgggtgctggagagacgctcgcgctgcgcaatcattgccctgccattgcgcgcgctgatcttccaatcgatctgtcgcgcctcatcgcccacctcataggcacgaatgtccagcagatcgtcattgcctccacgtcgtgcggaagcatgctccccctcaaggatgcccatggcacggcgcacggtgggcaggctcagcgacgtgccgagcatctcgatcttgcgtcggatcggatccgaccgattggcatcatgattggtgccgatcatggaacgggcaccacctgaacaatctggtcgacaatctgatcgctggtcacgccatcggcgagcgcctcgaacgtgagcaggatgcggtgacggaacacttcgtgcgcgaagcccctcacatcctccggaatcacataatccctgccggccatcaatgccgaagcctgtgcaatgcgcaccaatgcaatcgaggcgcgtggcgaggcacccaggcgcaccagggaggacaggccttggatgggcttcgggccgccgccacgagaggtctcggagagcgcaaccgcatattgcatgatcgcatcggagacatgcacccggcgcgcggtttcgcgcagccagtcgacatcctgaatcgagatgacgtcgcgggggagcttcgtcgggtcgatggcgtccgatccacggttgatcagcagccccagcatgcgctgttcctcgtcagcgctggggtaggtcatgatcgccttcatcatgaagcgatccatctgcgcctcaggcagattgaatgtgccctcctcttcgatggggttctgagtggcgatcaccatgaacggcttgggaagttcgattcgttggcctccgatggtggtggcgccttcggccatggcctccagcatggcggactgggttttcgcattggctcggttgatttcgtcgagcaacacgaaattggcgtggatcggtccgatttgcgtggtgaagcgttgggtggagaaatcgaacacctgggttcccacaaggtccgaaggcatgaggtccggcgtgcattgcacgcgtttgaacgaaccggagacggaggtggccagcgtctgtgcggctgtcgtcttcgccaggccgggcaccgattctatgagaatatggccgccggccaccaaggtggtgatcagggattctcgcagattggtctggccgacaagcgtttgcgcgaatcgcgagcggatgctgtcgaccaaccgaccggcccgttccgcatcgtttcttgagatcgggacggttggggactggagggtggatgggactggcggaggcgcggtcggttgggagggggaaaagaaagacatgtgccacctactatgtttgagcgtttcgtatgctgttctgtttcagttggttagtgtaatgcatggccgtgcaatgggcattcgacgcagccgtgcagtgtgctcgtcttcatgtgcctccagctattaccgtgcagggcaatcggacgatggcagcgaccagtcgaccggttcggctcccatctgcttgagtgctgcgttcgcgcgggagaagggatgtgatccgaagaaaccgcgcgatgccgacagcgggctggggtgtgcggatttgatgatggcggcattcgtcagcaacggctccaaggtctgggcgttacgcccccagagaatcgctgccagcggctttggcttgccgtgctcatcgacacggttgttgagtgcacgcacagcgcaatcggtcacaggttcccagcccaagttctggtggctgttcggcctgccaatctcgacggtgaggcagcggttgagcaattccaccccccggtgggtccaaggagtgaggtcgccgttgcagggtggcggcacgtgcagatcatcttcaagctctttgaatatgttgacaaggctcttcggcagcgggtggacgtttggcgccaccgagaagctcaatcccactgcgtagcctggagtgggataggggtcttggcccacgatgagcacacggatggagtcgaagggaatggtgaaggcgcgcagtatgttccggctggcgggggcgatatgttcgccatgcccgatacgttcacgcaacagacgccccatatggcgaatttgcggctccaccgggcgcagcgcctcggcccaccccggatccatgagttcctcaagaggtttgatttcggtcatgtctccactctagcccgctcgtgcaactccaggcttcttgcggctatggaccgtagcgcgtggacgtctgccgccggtattcgtgtgcggtggcccttgtgactccgacctggtataccccgacttggtatattggagccgacacttgtttgcactgcgtacggaaagggacggccatggctcgcaacgatgaccataagtatgagtcgtatccgaaggattccttcgacaatccgccgaccggcccggtcggcgtccacaatggccgtcgttcctggccagtgcgtctgaccccctatgcgatcgtgattgtcgtggccgccgccgttggtgtgttgttctggagcgcgttctccggggaggctgcgaacatgttcaaacatggcgatcgagagaccgtggtggcatccagcagtacaaccacgaccacctcgccgtcgtcgacgagtgccagtgagagcgaatccccctcacagagtgccagcgcctctgcgtcggaatcgccgtcgcagtcgccgtcgcagtcgccatcgcagtccagtgagtcgccgtctcagagcccgagcgaagagcagacgcccgagcagaaagtcaatctcgatgcttcgatcagtgtgatcaatggcactgccaccaatggatacgccgcccaggaggcgcagcggttgcagggcgctggcttcacgaacgtggcgcctagcaatccgaacggcatgcagcttccctcccaaagcgtggtgtggtatcagaacgacgctgatctggccactgcgcaaaaggtggcagaaacccttggggtgagcaccgtgcagaaagccgagggcattgcagtgccagtggccgtcgtactcatgaattgagtcgcctgcgtcgcatgccgacggagttcttccgcgacgaaccggcccgagggccggttttcttatgccaatttggactttgtaaaatcagtaaagttgtattgtcggttaggcagatgcgcgttctgcggtatttttcttatataagaaccggtttgaaacgccgaagctgcgttaataccccctcataactatcatggggaaagggtgaatggttccgggccgcaaatcggggaagtttgcgttgcgttcctctcatgagtcgttcgccttcacggagtccttcacgaaggaagatacaagggtatgccaaggggaacggttaaattcttcaatgtaggtcgcgggtacgggttcattactcccgaggatggtggggcggatgtgttcgtacattattcctccatcgaggccgagggtttcaaggcgcttcgccagggggatttggtggagtacgacagcaagcccactgacaagggtgaacttgccacgagggtggtcaagattcatcgttcctgaacggttatggagttcgttcacgatatctgcgcgaggctctgccccgatattcccgaaacgccgtcatctagcccatagcgcaaaaggcggtccgaaaagttggcactcgaccactgagagtgctaatctgccctgtagcacttcgggaacgggtgcgggagctgacgcccgtctcggacccaagtgggtaagcatgaatttctcgtggaggaacaatggcaaagatcattgaatacgatgaggaagctcgtcagggtatgctcgccggtctggataagctggccgataccgtcaaggtgacgcttggtcccaagggccgcaacgtcgtgcttgacaagacctatggcgcgccgaccatcaccaacgatggcgtttcgatcgccaaggagatcgatcttgaggatccgttcgagcgcattggtgccgaactggtgaaggaagtggccaagcgcaccgatgatgtcgccggcgatggcaccaccaccgcaactgtacttgcacagtccctcgtgcatgagggtctgaagaacgtggtggccggatccaatccgattgccctgcgccgcggcatcgagaaggcttccgacgctctcgtcaagcagcttgtcgcttccgcgaagccggtggagaccaaggaacagattgctgcaaccgcaacgatttccgcaggtgaccccgaggtgggcgagaagatcgccgaggctctcgacaaggtcggacaggatggcgtcgtcaccgtcgaagacaacaaccgcttcggcctcgatctcgatttcaccgagggcatgcgcttcgacaagggttatatttccccctacttcgtcaccaatgcggaagaccagacggccgtgctcgacgacccgtacattctgctcacctcgagcaaggtctcctcgcagcaggatgtggtccacatcgccgaactggtgatgaagaccggcaagccgttgctgatcgtggccgaggatgtcgatggcgaggcactgcccacgctgattctcaacaacatccgtggcaccttcaagtcctgcgccgtcaaggctccgggcttcggtgaccgccgcaaggccatgctgcaggatatggcgattctgaccggcggtcaggtcgtctcggaggatctgggcctcaagctcgattccatcgacctgtccgtgttcggcaccgccaagaaggtcattgtctccaaggatgagaccaccatcgtgtccggtggcggctccaaggaggacgtggccgcacgcgtcgcccagattcgcgccgagatcgagaagaccgattccgattacgatcgtgagaagctgcaggagcgtttggctaagctggcaggtggcgtcgccgtcatcaaggtcggcgcagccaccgaggtcgaggccaaggagcgcaagcaccgcattgaagatgccgtgcgcaacgccaaggccgccatcgaagagggtctggttccgggcggcggcgtcgcactggtgcaggctgccgaaaaggttgagaaggacttcaaccttgaaggcgacgaggccaccggtgccgcaatcgtcttctcgggcatcgaggctccgattaagcagatcgccgaaaatgcaggtctctctggcgccgtggtgatcgacaaggttcgttccctgcctgagggtgagggcttcaatgcggcaaccgacacctatgaggatctcatggccgccggtgtgaccgatcctgtcaaggtgactcgttctgctttgcagaatgcggcctccatcgcgggtctgttcctgacgaccgaagcggttgtcgccaacaagccggagccggcagcggcaccggccgccggccaggacatgggttactgatttagggtctttccggttccgttccgggacatacatagaaaagaggtggggcgttccgcagatcgatctgcggaacgccccacctcttttctatgtattttctatgtattccttcccgctcgcgcagctcgatgcgacctcacgatgtcgcgaacagccgtgtcgcctgcatctcggcatccgcataaacggtggaggcttgcgtcagggcctgctgcatggcctcgagcgatagctccatttgctgctgggtgcgacgccattcggaggcaaccatgttgaactgcgccgcggcggctccgcgccatgcatcctgcagggcattcaggttcgcatacatggtggtgaccgcatcgcggatggcggtgatagatgagcagacggccgcgctcgaggcggcgatgcgttcagaatcgacttggtattgtgacattgcatgctcctttgcatcgtgttcgttgtaataaaaaccgcgggacaacgtgcagctctcccgctactgttgactttatggcgaacaacaacgaatggacagcgcaacaggcaattgtggtcggaggacgtggtgacgatccggtcattgtggataacttcgggggcctcaagcggcaggcccgcgtctggacggcggttctctccgtcattatgttgttcgcggcgctcctcgtaggcgccactggtgcccaaatggctgcggcagatgattctccgtcgccgtctgccagcgaatcgtcgagtccgagtgccttggtggaggactctcaggggtacatcaccgatccgcagaacctgcttggcgacaatctcaccaaggtgatcgatgcggcgaatcggacgaagcaggagacgggcgtgacggtgcgtctgctctacctcgaatcgttcaataccacagagaagccggaacaatgggcctctcaactgttggagtcgctcaaccctccagccaacaccgtcatgcttgcggtggcctcccatgatggcaatctcgtcgtcgtggtctcaccgaattccgacgaatggcttcgcagccaaagcaccgtggaccagctttcggaggccgcgagcaaaccgctgctcgatcagcaggccggtcaggggccgaactggtcccaatccgccatcgacatgatggatgccattgccagcgcgaaatcgaccgccaccacccatgccgtgagctcggtgagcatcatcgtcatgatcattgtgtttgtcgtgctcatcgttgtcgtgctggtcatgatcttcatgcgccgtaagcgtgaagtgagcgaaggctccaagcagaccgaggaggttgggaagacgcggaacgacgacgccatgcagttggacaacgccgatgatgaccttgatgtcaccgccatggccccggaagagacatccgagcaacccgaaggcaaagaggcgcaagagccgaacccgacctccgaagcgtctggaatgcctgccccgcgtcgcgggcgccatgctgcggcaccgcatgatgacgaacgattcaaacgcccgaattaagttttcagagagcattcagaaaacttccagagtgttgcgtgattataggtgccatgagtaaagcaactgaagcaacaatcgtggttgtcgatgacgaaccctccattcgcgaattgctcgtcgcatcgctgcatttcgccggctatgaggtggagacggcggcatccggctccgaagccatcgaggtgatcagtcgcacgaagccagacatgatcatactcgacgtgatgttgcccgatatcgacggattcaccgtcactcgacgcattcgccaggagggcatcacggctccggtgctgttcctcaccgcccgagatgacacccaggataaggtgatgggcctgacggtgggcggtgacgactacgtgaccaagcccttcagccttgaggaggtggtcgcccgaatccgcgccatcctacgccgcacccgtgagcaggtggaggatgacccgatcattcgcgtcggcgatctggaaatcaacgaggattcgcatgatgtgacccgtgccggccagaccatagatctgagccccaccgagtacaagttgttgcgctacctcatggacaacgagggccgtgtgctctcgaaagcgcagattctcgaccatgtatggcaatacgattggggcggcgacgccgcaatcgtggaatcgtacatctcatacctgcgcaagaaggtggatgatgtcacggtgaccgatgaggatggttccacgcacaaggtgacaccgctcatcgagacgaagcgcggcatcgggtacatgatccgtgcaccgaaggcacagaagtaggcgaggggacatggggcaacagccacagggaccgggcggagatcattcggcgttaccctccccgaaatcagcggtgaaagacacgccgttggcccaggtggccgcagccgatgccaggaaagggcaatcctcgcagaatcagccgcacacccacagatcacgacgtcttgccgcgctcaatgagtgcattccgctgagcgtgcgcctcatgtcgatcattgtgggcatgctttcaatcggcaccattgtcatcaccttctccatacgctggctggtgagcagctacccgatggagcgtgtggaccagcagctgctggaacaggcggacctggtgttcccccagatgctcaatacggacgtgaatacccagaacggtttcaccagctattatgtgaaggtgtacaacaccaacaccggttcatcggcggtgatgttgcagccggtgcttaaggatggcgtgatctcgagccccaagctgcccgataacggttcgttggacggccatgagctcggtgtgccgttcaccacgcctgctgtggtgaatacgaagaacgttgtgggggttcccgaccatgccaccatgcagttcgctgaatgcccctggcgtgttgtggccctcaagggtctgacgaaatcgggcaagggggagttccaggatctcggcatcgtgtatataggcctctcgctgggtgaccagatcgatgtgatcagcacattgacccggttctgcatcatggtgagcatagccgtggtgctacttggcggttccttgggtgcattggtggtgcagcgaaccttgagcccgctcaaacgaatagagaagaccgccgcgaagattgccgccggcgatctttcccaacgtgtgccggaaagcggtgaatccacggagataggctcgctggcaagatcgctcaacagcatgctcacgcaaatcgagcggagtttccatgagcaggaggccgtgacgcagaagatgcgccaattcgtctccgacgccagccacgagttgcgcacacccctcgccgccattcatggctatgccgaactgtacaagatgcaacgggatgcgccggggacgttggagcgggcggatgatgccatctctcatatcgagtcatcgagctcgcgcatgacggtgctggtcgaggatctgctctcattggcccgtttggatgaggggcgcggcgtctcgatgaatcaacgtgttgatttcacctcggtgatgcaggattccgtagatgaccttcacgcactcgatccggatcgtgaaatcaccaccatgcaactcgacatcgatctgagtgcgccgaggaagccgaagctgagtgagactccagggccgttgccgaagatcgcattgaccggcgacgccacccgactccatcaggtgatcacgaatatcgtgggcaacatccaccggtacactccttcggattcgcctgtcgacattggtctgggcgtcatagagtcgagccgcacaccagaggacctcgcggcgatgccacaggacggcgacatgctcgaaacacttctgcagggagctcgcaaaagcaaatccagcaaactcctgagcatgtatgcggtggctgtgctgcgcgaccacggacccggcgtacccgagaaatcgcttcacaacatattcgaacgcttctacaccgccgatccgtccagggatcgtcagaagggcggcaccggactcgggcttgccatcgcattgtcgatcgtgaacgcacacggaggtcgtatctatgccagtccgaccgagggcagtggcttgactttcacgattatcctgcccatggagtccggcacggattgatgtgttggcgttcgccgaaggctccaaggagcctgcgtcggaatagcagacggaggaccttggttgttaggtgaggccccgcgtaagcttgcaatggttttgccagcgatgcgcgctggcggtagaatggacttttggtatgcggcggggccgcacgtattcgagacgatagaggtgaacatgcccagcggacgcattcgttggtttgacgcgaagaaaggctatggattcattgcaggcgatgacggcaaggatgtcttcctgccccagaccgcattgccgcagggagtgaggaacccgagaaaaggcgcgaaagtcgagtattcggtgatcgagggtaaccgtgggcaggtcgccatgggggtcaccatggtcgcctcggcgccatcattggtgaaagccaccaggccgaaaccggatgacatggccgccattgtggaggatctcatcaagctcctcgactccgccggcaatggtttgcgacgccaccgctacccgtcgtctgcggatagccgaaagctggccacattgctgcgtgccgtggccgatgacttcgatgtacaggactgatatggcaacaagtgaattcgatcccattgccttggcgagggcggaggcaatcgacaccgcgcatgaaccggaggatgtcggagagttcgtcaccagcgaggcccatgacgatggcgtgacggatttccgtttcgaggcgctcatgaagggatatgagggctggcagtggtcggtcacgctgtaccacgatgtcgagctcgaccattggaccatcgacgaatcctcgctgatccctacggacaaggcccttctgccaccgaaatgggtgccttggaaggatcgtctgcttcccagtgacctctccgtgaccgattccatcggcactccggaggatgatgaacggcttgatgatggtatcggcattgacgaggcggtcagccgcacagaggaactcaatgccgagcagcaggctgtcgagaccgtgcaggctcaagagggaggatcccccgatgagcaagccgacgcgttgactgccgttgaagatgtggtggaagcagtggaggaactcgacctgtcgaggcgtcacgtgctttcggaattggggcagacgcagacggcgcaacgctggtatgaaggtcctcatggccccaagtcgctctccacgaaaaccgccgatggcaatctgtgctcgacctgtggtttcttcattccgctcgccggcagcctcaaaacaatgtttggtgtgtgtgcaaaccgttggagcccggatgacgggaaagtggtctcggtggatcatgggtgcggagagcattccgagattcgtccgcctgagccaagtcgtatgtgggtgcagacaaagcccgcctatgacgatctgcatatcgatgtggtggcccagcatgggcgtgacgagcgcaaggacgaggaattgctcgaaagcctggatgaggttgatgcggaatctttggcagggctcaaacagaaggcactcgatatggacgacgacatgcccgataccagctcgttcggtatcgggtcagtgtcgccgcaggatttttccggtgaggaaccggaagcggattctactgtggagcgatccgctgccaaagaggtttgcgaggacgaggacgcagagcagattgactcgatgtgcaccagtgagacggtgattgctgaggaagccggcgaataacacgccagacgaatgtcagagggggctttcatgtgaacacacatgaaagccccctctgacattcgtctgcaaatcgggtcgatcacatgacattgcccgatttcgtcccgttggatttcgtcgtgttcgacccgtttccttcggattgagaggatgcggacgagccggactccttctgtttgcgcttgcctgtccccgcatcttcggaggaggtcgacatgctggcggatggcgagggactgggttccggcgaggttctggaggtgttggagggctgcgccgagggagatgcgagttcgttggctgtgccgctgtcgttgtgtgacttcgcatcatctgatgtcgtgccatgggtgctggaatcggtgctcggggaggtgggtggctgcggcgattcggttggcatttgtgtttcggacggcgagtatgaagggtcacccgtctgctcatcgccctgcagttcctgggggagcacgccggtcgtcgccagcagcagatcgcgggtcagcgttgtggcgttgtgtgcgagcttcttggcattgacggcattggtttgcagaacgccatcgttggcgatgattgagcatgacggcaccgacggctgttgtgcggattggtcgagatacgaggtcaaattgcgcagttgctcatcggacatgtctgtgacatgcgatgcccggtatgttttcgcatcgcccactgcggtggtgagcaggctgcgcgccgaattcgcgtgagagacgctggatcggcaatcgctcattgcggccgcgcgaggcgttcccgatatgttcccattggcatacaggtacaatccggcgattaggatcacaatgatgccgagcacgatcgtggtgatatgcatgggcagatgccgtctggctccgccgcgggcgctcttcgaggggcgctgcttggcatcggtatcttcgctatccgaggccggatccgtctcctcatgatgcggggggaatgacggtggcactaccgtgccatgcacttcatcctgatcgtccgttgtcgattgcgtcactgactctggggctgcggtcatctgcgcgctcgtttcgccgacattgtctgcagactcgtcatccgcactcatttattccacccatctatccgttgccataccagagccccagtgtagggagtggctctggctgcggcaatggaggtgtagctcaaagtgaacagatggcgtgtcaatgcaagggcatctgctccttcatggagccgatatctcgggtgaatgctgacagccgagaatcagtgcacaatggtgaggttgcattccgcgaggttgatgagttgcttggagaccgaacccaggaaatgcgcatcggccccggagagcccgcgggaaccgaccacaatatggcggcagtagcgtgaggcgcttaccaatcccttgcctgcgctgatatggaagacgtccgccttgatagtgagcccctcgggcagcgtgcttgaggcgataaggtgctgcaccacctgttcggcatgctgctgtgccacatcgaggggtggcacgcttgtctcatagccggggatgtcggtcatgtccttcaactgccagcagtacatcacatggaggggcgcatggttcagattcgccaaccatgcggagaactcgagtgcccgacgggacgtgggcgatccgtccacgccgacgacgatcggacggctcgttcggggcgtgtcaggtgcgggcaattcgaagtgaacttcttgagaaccgggcgtcagcgcgttggcaatctcatcctgcaccgattgatcctcgttctccacgcgaatgatcgtcacgggaatctgcgattcctcggcgagcgaagacgacagggagccggagaaccagcgggccacccgcccgagtgtgcgccgccccacgacgatctgctgggcgtcgctgccaatctcaagcagagcagatgtgcccgaggctcggaacgaggtgagacggatctggtcagagtcgatgtcgatgccttcggcagcatccttcacccaatcgcgaagtttttcggcgatctgcgtgcgcagcttcgcgagctcctcgtcggtggtgggttcaggtcccatgtcccacgaatacgaccagccgtacacggcgttcacggtctgcccggaaagtgcggcctgacgcaaggcccaacgcaatgcgccgaacgattcctgagagccatccacacccaccaccagatctccctgtgggttcagcgactgcactgttgccggttccatgacatctccttgccgttggtcgaatacgcactacatctaagcatagtgtaagtggcacgaggtgtcatgctccacacacggtgcgtgagcgatcagcatggggtcctgctcggcatgcagggtgatgcgaaatagcgcgatgggaataatacaatggtcaaatctgttcagcgagtacatgccattcaccgcatatgcggcacgcgccgtatacgcccatcccgcaatttcgcgggaaaacggaaataaacgttccgcgaattctgtagagtggtttggaattgtattgattatggaaggacaagcatgttcgaacggtttaccgaccgtgcgcgccgggtcatcgtgctcgcgcaggaagaggctcgtgccctccagcacaattacatcggcaccgagcatctgctgcttgggctgattcgtgagggagatggcgtggccgccaaggctctcgaagccaaaggcgtgacgttggaagacacccgcaagcaggtcgaggagatgatcggcaagggcaccgcggctccgacaggccacattcccttcactccgcatgccaagcaggtgctggagctctcgctgcgtgaagcgttgcagctggggcatagctacatcggaaccgaacatattctgttgggcctcattcgtgagggtgagggcgtgggcacccaggtgctcatcaagatggacgtcgatctttccgacctgcgcagcaccacgatcgacatgattcgcggcaactccggcaacggtgagggagacaagggcgacatggccaacgcgggttccgtgcaggacaagcgcagccagagcggttccgccatactggatcagttcgggcgcaacctgacggccgaggcgaaggacggcaaactcgacccggtcatcggccgcagcactgagatcgaacgcgtcatggtggtgctttcgcgccgtacgaagaacaatccggtgctgattggtgagccgggcgtcggcaagacggcggtggtcgagggacttgcgcagaagatcgtcgccggtgatgtgccggagacgctcaaggacaagcaggtgtattcgctcgatctgggttccatggtcgcgggatcgcggtatcgcggtgattttgaggaacgcttgaagaaggtgctcaaggagatcaagacccgcggcgacatcgtgctgttcatcgatgagattcatacgattgtgggagctggctccgcggacggggctctcggtgcctccgatatgctcaaaccgatgctggcgcgcggcgagctccagaccattggcgccacgaccaccgacgagtaccgcaagtacatcgagaaggacgccgccttggaacgccgattccagccgatccaggtgtcggaaccgtcgattgccgagacgattgagatcctcaaggggttgcgtgcacgctacgagaatcaccaccatgtgacgatcaccgatggtgcactgcagtctgccgcagaactttcggcacggtacattcaggaccgcaaccttcccgataaggcaatcgatttgatcgatgaggcgggtgcgcgtctgcgcatcaagcgccttaccgcgcctccggagctcaaggagcttgacaaccgcattgcgcgcatcgccaaggagaaggaccagacgatcaaggaccagcagttcgagaaggccgccgagcttcgcgacaagcaggagaagcttgaggctgagcgcaaagagaaagagaagtcctggcgtgagggcgaatccgacgtccgtatggtcgtcgatgaggatgtgatcgccgaggtgatctcgcagagcacgggcattccggtgttcaagctcacccaggcggaatccaagaagctcatgtcgatggagaaggagctgcataagcgcatcatcggtcaggatgaggccgtctctgcgctgtcgcgctccatccgccgtacacgtgtgggactcaaggacccgaagcgtccggcgggatcgttcatcttcgccggccccaccggcgtgggcaagaccgaacttgccaaggctctcgctcagttcctgttcgacgatgaggatgcgctcattcgcgtcgacatgtcggagttctcagaaaagtacgcggcttcgcgtctgttcggagcccctccgggatatgtcggttatgaggagggtggtgagctcaccgagaaggtgcgccgcaagccgttctccgtcgtgctgttcgatgagatcgaaaaggcccatcccgacatcttcaacacattgctgcaggtgttggatgacggccacttgaccgatggccaggggcgcaaagtggacttcaagaacaccatcatcattttgacgaccaatctcggcacgcgtgacatcgcgaagaccgccaatacaggcttcacgatggggggcaacaccgaatcgagctatcagcgcatgaaggaccaggtgtcgagcgagctcaagcagcagttccgccccgagttcctcaaccgtttggatgacatcatcgtgttccgccagctcaccgaaccgcaggtgcgccagatcgtcgatctcgatgtcacgaagatcaacgatcgtctgttcgaacgtcatatggagctcgacctgaccgataaggccaaggatttgctcgcggaaaagggcttcgacccgttgcttggtgcccgaccgctacgtcgtgtgattcagcgtgatatcgaggacaccatttccgaaaagattctcatgggcgatctgcacgacaacgaacgtgtgatcgtcgatgccgaaggtgatggcattctcggggagttcacgttccgcggcgagcctttcgagctcccggcggcaggcgaaggggacgagtcgaaggatgtcgtgcccgaacctgcggctgcggcgagtgaggccgaataatcctcgagacgataagcgccgaataaggggcggcgcggacgggaatcccgtccgcgccgcccctttcgtttcccgccagtgaagacatcattgaattcatatcggtaaaacatcgacgaagacaagaaaaaatacggaatatgggtagtatgtgaagaatacttaagaaatagggtatcttatttcggaaagctgtatagtcagaaacataggggagggtagcgaatacagaaaagggaaacaggaaacaggccgagtgtgcaagggggtatgcgacggcgggtgttgtggcacgcgtctgtgcagagaggaagacgcgtgccacaacacatggggaatggggatgcacagttttgctgtgcatccccattccccatgctcttagcagtttggcgaggaagtcagtcctcatcctcttccggatcgtaatccacgccggtttccgcacgctgttcgtcggaaatcggtgcaggtgcgcctgtcagtggatcgcgaccgccaccggccttcgggaaggcgatgacatcgcgaatcgaatccgcgccggcgagcagggcaaccgtgcggtcccagccgagtgcaatgcctgcgtgcggcggcgcgccgtacttgaatgcctccagcaggaagccgaacttatcctgagcctcctgaggcgtgatgccaagcacattgagtacgcggtcctgaatgtcgtcacggtggatacgcaccgagccgccgcccatttcattaccgttgcacacgatgtcgtaggaatcgctcatcgcatgctcgggatcctcatcgaaggtgtcgatccagtccttcgacggcattgtgaacgggtggtgcatcgacgtccacttggaatggccgactgcaacgtcgtcgtcgtccgggtcgtcggtgcgcttgaacagcgggaagtcgaccacccagcagaatgcgaatttcttcgggtcgagcagaccggcgcggttggcgagttcgacgcgtacggcaccgagcagcaactgggaggattcgcgggcacctgctgcgaagaacacggcatcgccatcctcggcacccacagcttccttgagcccattgcgttcctcgccggagaggttctttgcgacaggtcccttgagctctccattctcgccgaacacgacgtacgcaagacccttggcaccacgctgcttggcccaatcctgccaggcgtcgaactggcgacggggagtggaggcgccgcccttgaagagcaccgcgcccacgtatggggcctggaacacgcggaacggcgtgttcttgaaataatcggtgagttcgatgagctcgtttccgaagcgcagatcaggcttgtcggagccatacttgtccatggcctcctgccatgggatgcgacggatcggcgtctcaatgtcgtatccatcggccttccagatggctttgatcacctgttcggccatggcgatgacatcctcctggtccacgaagctcatctccatgtcgagctgggtgaactcgggctgacggtctgcgcggaaatcctcgtcgcgatagcagcgggcgaactggtagtaacgttcgacaccggccaccatgagcagctgcttgagcagctgcggggactgggggagcgcataccaggaaccgggaaccagacgtgccgggacaacgaagtcacgggcgccctcgggtgtcgacttgatcatcgtcggggtctcgacctcggtgaagccgagcttgtcgagctcggtgcgggcggcgcgcatcatgtcggaacgcagcttgatgttgcgctgcatggccgggcgtcgcagatcgaggtagcggtacttgagacgcacatcctcacccggcagcttgttctcggattcgttttcgagtgcggtggacacctggaaaggcagcgcgtcggactttgcgagcacgcggatcttctcggccacgacctcgaccttgcctgtcgccagatggtcgttctcgttgccctccggacgctggcgaaccttgccgtccacctcgatcacatattcgctgcgcagcggacgagccatctcctcctcgttgatgaccacctgcaccagaccggtgttgtcacgcagatcgatgaaggccacgccgccatgatcacggcggcggtccacccaaccggcaagcgtgacgtgctcgccgaccagaacttcggtcacgtcggtggcgtgatgtgtacgataagccgtctgctggctcatgcttcctctattctccattgcattgttcttggataaaactgttctgaacgccgatttttcaacggttgtcggcattgatggaaacggtttgctgggcatacacagtatccggttgccacgactgtgcatcagctggacgctgatctccggtgatgatgttcttcacctcgtcgctgccgtcgttctcggggttctcgttcgggaaccagacgtatgggattccgagtttgtcggcgtacttgatctgcttgccgagcttggccgccgtgggcgccacatcggccgcgatgccgcgggaacgcaacgtattggcgatggcgttcgaatcccctcggttctcctcgtcccatacggccacgagcacacatgccggcgacatgcggcttgccgtggcgcccgccctgtgcagcatgtaggagaccaggcgagacaagccgattgagagacccaccccggggtatttgcggttgccctgcgtggccagattatcgtaacggccacctgagcagatcgatcccagatcgctcgctccttcgaggaacgtctcgtacacggagcccgtgtagtaatcaagcccgcgggcgattttgagatcggccatgaccgaaccggggcgaatgcggcgggcctcgtcgatgatcattgaaagggtgtccagaccctccttggccatggcgtactcgtcgccgtcgaacgggatatggtggatttcgcacagtccattgaacttctcgatgagctcctggccgtcctccgcggtgacctgtgcgagctccaggcaggcattcgcctgtgcctcggtggcaccgcaggtctcaacgagcagatcggtcaccgcttgggggccgatcttgtcgagtttgtcaatctcgcggagcacaccctcgatatcggtcagaccaagcccacggtagaagccctcggacagcttgcggttgttcgcgtgcacggtggccttcggcaagccgaattcacgcagccgttccaatgcgttcaccatgaccaacgggagctccacctcatagtgcgaagggagcgtgccgtcgccgaccacgtcgatgtcggcctgcacgaactcgcggaaacgcccttcctgcgggcgctcgcccctccacaccttctgaatctgccagcgtttgaacgggaacggcaacgcgccggaatgctccaccacgtacctgctcagcggaaccgtcaggtcgaagtgcaggccgagccgttgttcgacagggatgtcggattcatggccgacctcctgaagacgggagagcaggtagatctccttgctcgtctcgcctttcttcaacagactcgacccctgttcgacggcacgcgtttcgatgccgatgaacccgttgagctcgaatacctcacgaagcgtatcgatgacacgctgctccaccacgcgttcagcggggagccattctgggaaacctgatatagatgcaccttttgccacgttccatataataagtggggtcggggaaaaacgtcggtggcggactatcgtgagtcttgtctatactgggctagtgtgttccgaggaagggaatgtgcttcccctccccatctcgcaagctaaggagctgaccatggccgattccaacgtcaccgaatccaagaccacagacaacgcagtcgcgaacgacgaggcgacgacgccggccgcagccgtgccgagcccggcggccatgaaggcgcatgctccctcaccggccgttctcgccaagagccctgtggctcatctggcgtcatcgtcgtcacatgacgatgtagagctcaaggaggcggagagcttcggccgtgtggatggcaacggcaccgtatacgtgaaggagggcgaggaagagcgtgaggtggggcaattccccgatgcgtcggccgacgaggcattggccttgtacgcgcgccgttacctcgacctcaaggccaaactcgacgtattcgcaaatagactcaagtccaattcgatcaagccccgtgagatcgacgagacgctcgccgcgctgacggaggaagtcaagcagccggcggtcgtgggcgacatccccgcactccagtcgcagttggaagagctgcgcaagaaggctgcggcgaagaaggacgccatcgcgaaagcccgcaaggaggccatgaccaaggcaatcgccgaacgcacctccattgtggagaaggccgaggcccttgccgccggactgggtgataacacgaactggcgttccactgccgacaagttccgttcgctgttcgagcagtggcaggagcatcagcgcactacgatccgcatcgacaaagccgaggcggatgctctgtggaagcgcttctcgggggcacgcaccaccttcaaccaggctcggcgcaaatgggctcaggcccgtgatgccgagcggtcccatgccaaggcgcagaaggaggcgatcatcgccgaagccaacgaaatcaaggattccacagcttggggcgagacctcgcgtaagttcaacgaactcatggaccgttggaagaaggcaggccgtgccggccgtaatgaggatgatgcactgtgggcacagttccgcgccgccgccgatacgttcttcaatgcgcgtcaggccgaccgtgaacagatcagctccaacgagaaggagaatctggcgcagaaggaggcgctgttggcgaaggccgaggcactcgtgccggtggagaccggggaacaggccaagcaggcacgtgtcaagctcgcgcagattcaggaggagtgggatcagatcggctatgtgcctcgtgaggacatgcgtcgcatcgaaggtcgtctggatgccgtggacaaccagatcaaggccgtcgaagatgctgcctggaagaagaccgatcccgaggccgatgcccgtaagtcgagcttcgaaggccagctcaaggcacagctcgccgagttggacgaacagatcgccaaggagtcggacgccaagaagaaggcgaagctggaggccgagaaggcgaccaaggagcagtggctcaacgccatcatgtgattgcatcgcatccacgcccccatacatgacggaagcggccgaccctaggcggggcggccgcttccgtcatgtatgggggcgtctgttatagccaatagcttgaatcgagaagaaccgggttcttcgcattacgatgagatgcagaacaccagtacgtgcatcccatgcaggaggcaatatgacgacgagcacacataccgaggaaatcaccgtgatgcgtgatgggctgaggcttcatggacgcatcgacgcaccacagggcgaaccgaaagggccggtggtgattctgatgcacgggttcatggccgatctggggtatgaacccggcagcctgcttcagcaggtgagcgaccagctcgtcgaagcgggattcacgtccgtgaggttcgatttcaacggtcgtggcaacagtgacggatcatttgcgaattccgacgtctgcaatcaggtggaggatgccatcgcggtactcaattttgtacgtgatcgtttcgagccagcggagatctcattgctcggacattcacaaggcggtgtgattgcaggcatgacggcgggtatgtatgccgatgtggtccattccctagtcctgctttcgcctgcggcctcgatcaaggatgacgcattgcgtgggcgtgtgcttggcgtcccattcgacccctatcacattccacggcgcatcgcgctcgcggatggcaagcatgaggtcgcaggcaaatactctcgcatcgccaagacgattccggtgtatgaggcggctgcgatgttcaagggacccgctctggcgatccagggtgagcaggacaaggtgatcgaccccagctgcgcgcacaactacggcaacgctatggcgaactgcaccgtgagcctgtacacgaacctcgaccacaagttcaacggcgatgaccgcatgcgtgcgataggcgaggcggtggcattccttcagacgcatcatgaggtggcgtgactcgtttgcactcattctgccgaaatatacaaaagactataatatgtctatttatttcggaatatgagacatcaggggcattgattttgcatgatatcggcccaatattccgtgatgagcgaacagaggtaacatctcgttacacatgggattataaactatgccgctatgagcgaaaacaacactgtggaacaattgtcgccgagcggcgagaacgcccatcatctcgtggaactcgagcatgtggagaagtactacggtaatctgcatgtgctgcgcgacatcaatctgaaagtagacaagggcgaggtgctcgtgattgtcggaccgtcgggctcgggcaagtcgacgatgtgccgcaccatcaaccgattggagaccatagactccggtgtcatccgcatagacggccaggcattgccccaggagggcaagggtctggcccagttgcgcgccgaagtgggcatggtgtttcagtcgttcaatctgttcgcgaacaagacgatcctggagaacgtcacgcttgcgccgatcaaggtgcgtcacatggaccgcgatcaggccgagaaggaggccatggacctgcttgcgcgagtcggcgtcgattcgcaggccatgaagatgccgtcgcagctatcgggtggacaacagcagcgcgtggccatcgcgcgctcgctggccatgcatccgaaggtcatgctgttcgacgagccgacctcggcgctcgaccctgagatggtcaacgaagtgctcgacgtcatggtcgaactcgcccaggaaggcatgacgatgctgtgtgtcacacacgagatgggttttgcgcgcaaggcggccaataagatcgtgttcatggccgacggccagattctcgaacgtggcacgcccgacgagttcttcgagcacccccagacggagcgtgcccaggagttcctgtcgaagattctcacgcactgatgcagtatgggccatgcacgcctatggattccgttgaggagagcggaatctggttcgtcatgcatggctcggtgaagggagaacgatgaaacatagatacaagaaggggttggcgcgcaaggcaatcgccatggtgtgcgccgccagtgcgctgttcgggatggcggcctgcggttcgtcgtcggcggacggcgagaagaaaatcaggatcggcatcaaatacgaccagcctggcttgggattcaagaagagcggcacattcgaaggctttgacgtcgacgtggcacgatatgtagccaatcaactggggtataccgatgccgagatcgagttcctcgaggctccgtcgaaacaacgcgaagccatgttgcaaaacggtgatgtcgacatgatcctggcgacctattcgatcaccgacgagcgcaagaaggcggtttcgttcgcggggccgtacttcgtggcggggcaggatctaatggtgcgcgcagacgaccattcgatcaacggtccggaggacctcaatggcaaacgcctgtgctccgtgaccggttccacgtcggccaaggtggtgaaggagagattcgccaaggaggtccagctgatggagcagcccggttatgccgaatgcgccacggcgctcttctccggcatcgtcgacgcggtgaccaccgatgacatcattctggccggtctggcctcggcgtcccgtggcaagctgcgtgtggtgggcaagccgttcacgcaggaatactacggggtgggcatcaggaagggtgacaccgcattcgccaagcagattaacgccgccattgaagacatgatcaagagcggtgagtgggaacgggccatcgagaagaacaccgaaggcaccgattaccaaccggatccgaaatataacccaccgacaccggacgaaggggagtgagcggcatggaaggattcatttccctgttcagaagctataacattcccggtgcgttcctcgtcaacatcgaactgacgctatgggctgcgctgttctcgacgattctgggactcattctcgtcatgatgcgcatctcaccggtttcgtcactgcgcaaggtgtcggccggctatgtcgagctgttcaagaacatgccgctgacgatcatcatggtgttcatggtgctgggcgcgttcgcgcagctcaagctgagcttctccgacaacttccagacgaacttcttctggctcgccgtgactggcctgagcctgtacaccgccgcattcgtggcggaatcgttgcgctcgggcatcaatacggtgcccaaggggcaggcggaggcggctcgggccatgggcctcaacttcatgcagtccgccacactgatcatcatgccgcaggccattcgaggatctgttgcaccgctcggcaacacgctgatcgcactgctcaagaactcgaccgtcgctgcagcggcgtcggtggccaccgagacctcatcgctcatgagcgagatgatcgagttccggcccgatgtgatcatccagatcttcctcatcttcgcgatgggatacgtgattctgatcctgccgatcggcatcctcaccacgtacctgtccaacaagctcgcagtcaggaggtgaaccgtgggtaattcagacgaaagctccctgctgttcgaccagccgggccccaagggcctcaagcgcattcgcatcatcaactgggtggccacgattctgttcgtggtcgtgctcgtgctcattgtgctgcgtctgcacaatccaccggacggcgaaaaccagctcagctgggaattgtggaagccggcgttggacggtgaagcgtggtcggacttctatctgccgggcctatgggccacactgcgcgcggcgttcctggcggtgatcggttcggtcgtgttcggtctggtgttcggcatcggtcgtctgctgccgagcaggatcgtgcagggaatctgcgcgattgtcatcgagttctgccgtgcagttccggtgctgatcatgatgatcttcttctggcgtgcattcgccttcctggatctgccgagcccctcctattgggccgtcgtgatctcgctcgtgttctataacggttcggttgtcgccgagctcatccgctcgggtgtcggaaacctgccgggcggccagcatgaggccgcagtggcactgggtatgacccgtacacagtcgctgatgagcatcgaagtgccgcaggccatctacgccatgctgcctgctgccgtgacccagctcgtcgtcgtgctcaaagacacggcgctcggttcgatcatcatgtacaccgatctgctgcaggagtcgcgacgcttaggctcgatgtacttcaatattctgcagacgctcgttgtagccgctgtgatctacttcatcatctgctggctgctgtcgagactggctgaatggctgccggtgcgcatgcagcagcacacactcgcgccaaccgagcccgagccggtggcaccgattgccatcatggacccgtccaacgtcaaccagatcgcggtggcgaaggaggggcgcccgcttggcggttcccagcgcctctatcatgtgcaccatcgtggcaccaatgcgaggatccatggatggcgacgcacgcgctatgtgcaaggctacgatgaaacacagccacagagccagcatgttccggccgagcaccatatgcaccaccattcgaagggtgcaggggagcggtgaccgaccatccatgtgaaccataacgcatacggcatgcgaatgtggggtgcgcatctgcgcaccccacattcgtttttggccagtgcacgtgtcacatgcctagaatgttggtatggcaagcgacaagaaaaacggcagaggttcgaaaaaaggcgaatcaatcacggtggcagaacgcaaggccaggaaggtggccgaacgcctcgcccgggaggcgaagagcagtgaaacgctcagtgccgtatggtcgttgcccccggcgcagttattgcggttccattcacatacgcatttggtcgacatcgatgccgggtcgaaaccggggtttgacggtgaccaagaggctggtgagcggttcattgccgacagcagctccgaaatagccaactatcagcggctcatgtatgccaatggcatccatggcgacacgcatcgcgtgctcatcgtgctgcagggcatggacgcctccggcaaaggcggcattgtgcgccatgtattcagtcaggtggatccaatgggtattcactaccatggctttggcaaaccaagcgaggaggatctcgcccatgactacctgtggcgtattcgcagggagttgccgtcaaatggctggatatccatcttcgatcgttcgcagtacgaggacatcgtgatgccacgcatcacaggttccctgcctgaggagacatggcgcgcacggtatgggcagatcaatgacttcgaagcagagctcgccgggtcaggttgcgcgatcatcaagatttttctcgtgtcgagcaggcaagcgcagcgacagcacttcctgcgacgtctcgatgatccgacacgatactggaagttcgacccctccgatctcgaagcccgtgacagatgggatgattacatggcggcctggcaggaggtattcgaacggacgagcacctcgattgccccgtggtatctgatccccgcggacaagagatggtactcacgtatggtcgtttctgagttgctgcgcacgaccatgaagaatttcaaccagacctggccgccactcgacgccgaccgtgatgaggcgttggccagactcggcgtcgagtgaatactatttgggtctcactgcgcttttacggtggcggcatcgttgtcgttgactacgtcacgcaccgaatagtcggtgaacaccacttctccgctttcctgcgtggcatcgagattcacagtgccggtgattgcccagtcatggtcgccgtcggaatcatcgatgatttggcgcaccgtccactcgtggcgatcctgctcatggcgagtgtcgagaacgaaatactcaccaccacgggcttcggcatccgtgttcacgtactcgtgctcgtcatagaagtcatcgagcacatcctcccacgtgtgcacatcgtaatgccatgccttgtcgagtgcacccaactcatcaggccggtcgaggtccatgagctgcacacggcggaacatcgcattgcggatgagcacgatgagcccgcgacgatcttccaccacggcgttggccacattcggtgcggcgaggttcgcggcctcctgcgcctgtgtgccggcgttttcccattcgtccacgaggctggagtcaatggagcggaccagaacgcgcaaccatgcgatgatgtcgtcgagttcctcattgcgtttctccgggggtaccgttctggccagcacacggtatgcatcagacagatagcgcaacagcgtcccctccgaacgggctgcgttgtaccgggcgatgtagccgttgaagtcggatgcagtctcgaccatgtcgcgcaccacggacttgggattgatccagtagtcgttggcccagggaacgtctttccggtactggtcgaatgcttcagtgagcaggtcattcaatggtttgggataggtgatgtcttgcagacggtcgagacgttcatcgtaatcgacgccatcggccttcatctcctccatcgccttgtcccgagcctgccgctcctgggcgcgcagaatctgctttggatcttccaacgtggcttcggccatagagatcacatcgagtgcatacgacggggaagcgggatcgagcaattcaagggcggcgatgaggaatgggcttaacggctggtcgagcgcgaaatcctgcggaagatcgacggtggtgtagtagtagtcgcggccgtcttcctgttcgatttcgattacatcggtgtcgatgagtgtgcggaagatctcatcggcgcgggtgcgaagtgcgttcttctgctcatcggtctgcgcggaatcttcgatgagccggtcgatgcgttttctggcatcgcctccctgggcgacttcattgagcaccatcgaatgggttatcttcatatgggggatcagcgtttccggttctttcccgattagcttggcgaaggtggactcattccatgtcacgaatccctccggtgctttcttgcgcttgatcttcctgagtttcttcggatcaccgcctgccttcgccagggcacgggcgttttcgatctcgtattcgggggcttcggcgatcaccagtccttcggtgtcgaagcccgagcggcccgcgcgtccggctatctgatggaactcacgtgcacgcagttttcgcatatgggtgccatcgaatttggtcagctgcgtcagaaccaccgaatggattggcacattgatgcccacgccaagcgtgtcggtgccgcagatgacgggtagcagcccctgctgggcgagttgctccaccagacggcggtagcgggggagcatgcccgcatggtggattcccacgccggtgcggagcaaccgttggaggatctttccgaagcccgttgtgaacttcgtgcccttcatcgccctggcaatcgcctcgcgttgctccttggtggaaaccccggtgttcgacagcgactgcgcggtgtcgagtgcggcatcctgcgagaaatgcacgatgtaaatgggggtctcaccgttctgcaccgccagttccaccgtcttctcaagtggatcggtggtatatcggtagctgaggggtacaggccggcgtgcttcggcaatgatgtccacgtcggtgtcggtgaggtcctcgagcgaatctgcaatcgtgtccacattgcccaacgttgcgctcatgagtaggaactgggcctgggggagggtgagcagcggcacctgccatgcccagccgcgttcgggatcgccgtagtaatggaattcgtccatggccacgcagccgatgtcagcccgacgcccctcccgtaacgcttggttggcgagaatctcggccgtgcagcagatgatcggcgcttcggcgttgatatgcgagtcgccggtgatcatgcccacattctccctgccgaacacgttgaccagctcgaagaacttctcggagaccagtgccttgatcggcgcggtgtagtatgagcgccgcccggtgcacaatgccgcgaaatgcatgcccagcgcgaccagtgactttcccgagccggtaggtgtgttgagcaccacatgatcccccgccagcaggtcgagcaccgcctcctcctgatgcggccacggctctatgccacgctcctcgaccacccagtcgaagaatcgctcatagatctcatcggcatccagcgatcggttgtcctcccctcgggagggaaccaatctcatcaatgccgtccgttcgtcatctgcctctgccatgttcgttcctcacgcctgcgcatccatattccgttgcaatgctagtcgaagagcatgatggacacaccatagcgtcgaacatttgttcgaattcgtcttggtggctacactgttgtctatgagcgatgacatgacgaacgacctattcgcggcgagcgacccatcagaagaggtggtgagaccgctggcggtgcgtatgcgtccgaccaccctcgatgaagtggtggggcagcgccatgtgcttgcgccgggatccccgctgcgccgtctcgccgactcggcctcgacgggttcgctcaccgccccgagctcggtgattctattcgggccaccgggtgtgggcaagactacactggcccatatagtcgcgaagcaatccggccggcagtacgaggagctctccgccgtcacgtccggcgtcaaggatcttcgcgaggtgttgcgccgtgcccatgagcgattggtgagtcaaggcaaagagaccgttctgttcatcgacgaggtgcaccgcttctccaaatcgcagcaggatgcattgttgcccagcgtggaaaaccgtgacgtgaccttcatcgcggcgaccacggagaacccgagcttctcggtgatcaaaccgctgttgagccgttccgtcgtggtcaagctcgaatcgttggaacctgaagagcttcggaccgtgatcgaacgggcggtgtcgaaccctcgaggcttgggcggcaaggtgcgcgtgcaaggcgatgccgtggatgggatcattcgtctggcgggcggagatgccaggaaatctctgaccatacttgaggccgcagcaggtgcagttgacgaatcgggatcgaatgttcctgccgaaatcaccacagacgtggtctccaccgtgatggacgtggcggctgtgaggtatgacaggaacggtgacgatcactacgatgtgatctcggcgttcatcaaatcgatgagaggttccgatgtggacgccacgctgcattacctggcccgcatgatccgggccggggaggatccgaggttcatcgcgcgccgcatcatgatcgccgctgccgaggaggtcggtatggcggcaccgcagatcctgcagatcaccgtggccgcggcgcaggcggtgcagatgattggcatgccggaggcccggatcattctatcggaggctgcgatagcggtggcgaccgcgccgaagtcaaatgccagctatacggccatcaatcaggcattggccgatgtggatgcggggctcataggtcaggtgccgctgcatattcgcaatgcacccacgacattgatgaaatcgtggggcaaccacgaagggtaccactacgcccatgattacccgaatgcggtggtggaacagcagtacatgcctgacgtgctcgtcgggcgtgaatactatcatcccaacagtcgcggctatgaacgagagataggcccgcggctcgaccggattcgcgccatcatacacggcgaaccggctccaccggccccgacccagacagaacggaaaccgacggaaccggtagatcctgcgcataccgagcatcccggtgaaactcaacgctcacagatgaaaggcaagaatgacgacgcgaccgacacagggcggaaagaagaggatcgcgaacccggcggcgaatgacgatcgcatttccccgaagctcatcggctcgatcgtttcggtgggatccctggcattcataggaatcctgaccgaaaccgtgatgaccgtactgttccccgaacttatggtggagttctcggtgaacactgcgaccgtgcaatggatcaccacgatctatctgctatcggtgggtgtcaccatgcccgtctcctcttatctcaagcgtcgtttcacaatgaaatccgtattcgtggcggctgtggcgctcgctgttgtcggttcgttcatcatgatcgtgggcaccagctttcctgtcatcatcgttgcccgcgtcattcaaggtgtgggttccggcatcgcgacgccgctgatgatcaacatcattcttgagcagtctccccgctccaaggtgggtaggctcatgggcgtgggttcgctcgtcatcaccgtcgcaccggccataggtcccaccgttggtggcgctgtggccagtatctggccgtggcgttctattttcgtcatcgtcatccccgttattgtgctcatctcgttgcccataggactcaagtgcatcacgcagacgaagcccacggaggcggtgagtctgaatccgttgcaattcctcgccatcatcgtaggactcgccggcatgattctctcgctgaaccaaggtggcgtggccgtaagtgagggcgtgtccggtgagccgtggggccggtcggccgccatcgccatcgtgagtctcgctgtcggcgtggctgcccttgtgttcttcgtgtggtcgtctcgccgctcgttctcgccgctcatccgtctgggatggctcaaagacaaggtggtgatgctccacctcattccgtacacgctgctgcccatggtgggaatcggcttcggctatgtcatcaccaaccttgcgcagctgagccttggcacgagtgcgctcgttgcgggcatgctcgtgctgccgggggccctcatcggcgcgttctttgcgccggttggcggcatgttgtacgacaagcacggtcccaccaagcccattctgggggcattcgcctgctgctttggcgccttggtgctattcctaggcttctccatgtatctgacgtccgtgctcatggcgtcgttctatttcatcttcggagtggggtacgccctcggcttctcgaatatcatgacggacgccatctccggcatccaccatgagttcacgccggatgggaacgccgtgttcaacaccgcgctgcaattcggtggagcggccggcaccacgctgttctccacaatcctggccatcgcgcaggctggtcatggtgccgagggaacgcctgtatacaggcatgccactgcggttggcggcacatggactttcgccgtcatgctggctattgtcgcagtgtcttggattatgctggctcgggcttttgccctgaacaaagcccgcatggagcagcgtgcatgaggccatgcgcaatataaggaggcctgtgcgattcccgggaatcgcacaggcctccttatatgcattccgaaagctggtcagctggcttttttgcgtggcacgtagatgaccgtgtcgatgagtttgcggtaatggtcgatgatctgcttgcgccgcgtcttgagacttggtgtgagcatgccgttttccgaagtgaattcgtcgggcagtatttcgaacttgcgaatcgattcagcccgggagaccccttcgttcgccttgttcacaatgcgctccacttcggtgtgcacgattgggttctttgaaagctcttccagatcggctgccggtttggctccctgcgaggtcaaccatgcattcgcatcttcgaggtcgagggtgacgagagccgccacgaacggcttgcggtcaccgatcaccaggcattgggctacgaccggcgaagtcatcacagtggtttccaaatgcccaggggagacgttcttgccgccggcggtgatgatgaggtctttcttacggccggtgaggtggatgaaaccctcatcgtcgatgtcacccagatcgccggtatgcagccagccatccacaatctgctgcttggtcacctccggctggttgtgatatcccatgcagatgtcgcgccccttgaagcacagttcaccgtcttcggcaatgcctgcggtcgtgccgcacagaggctgaccgatggtgccgatgtggttgttctcaggcaatgagacacaaacgggtcccgaggtctccgtcatgccatagccttcgagcagcggcatgcctatgccattgtagaaatgggccagatccgagtccatcggcgcgccgccggtgatggcgaagtcggcattgcggccgaacaccgtgcgaatcttcttgtagacaacggcgtcatagaacgcatggcgcatgcgcaagcctgcgggaattccgttgccggattgcttggccttgctccattcgcgtgccacgcgtacgccgcgggcgaacatgcggccggcgaaaccagtgcctgcacgttgggaggcggcgttgtacaccttttcgaatacgcgcgggacggcgagcagcagagtgggaccgaagtcctcgaagtccttgatgatcgtcttcatattgctggtgaggccgagagtgagtgtgccggcaaaggccaccgtggccatgaatcgtgcgaacacatgggaaagcgggaggaacagcagcaagcggcggtcggggatgtctattgcgcgaggcatgtactgtagggcgtccatgcattcggcggccatgttcccgtggctgatttccacgcctttgggggtgccagtggatccggaggtgtagatgattgtggccaacgtgtcgccatggacggcggctttgcgctcgaggaactgctcctcggtcacgttggccccgaaggcgatgattgcgtcaatggcggccgaatctatgacgaatgaaccacgcatcgatggggtgtcgttggcgatggattcgagcttgtcgcgttgcgcgtcgtcctcggcgaaggcgagcaccacttcggcgtcgttgaacaccatgcggatttgcgcaggtgagttggtctcatacaccggcacggtgacacagccgatggacatgatggccatgtcaagggccacccattcccaacgggtgtgcgcgatgatcgcgatggattcgcctgcgcgtgcgccccatccgataagtcccctggcgatggccaccaccttgtctcggaactcagtagccgagaaggtctgccagatgccgttggcgtctttgtagctcaccatggagccgtcgggattgcgctgcgcgcgcccttccagaaagtcgaacagattgatgtccggatcaatctcgtgcttgagtggggtggtgtactccttgacgatgccggcgtcggtcacttcgtctgcgcttggtgcgggctgctgcgcgttggaatgattttcacttgtcatacttaaggaatacaggattgaggatacaaaatcccgtttaggtgtttcttacggcgtagtaacccgtaagtcgcgcaaaactgccgatagagtcccatgcaaaaatagacaaaatagcttgaggagggttgtgtgtcaaatgttggtgtttggctccgggtatgaaggaggtcatcgcctggaatcggttaaagccaaaaacaactgatttgaggagatgaccttgatgaccagtgtatccgatgatgtggccctgacgatggatgacatgccgttgggcgaggacgggctgatcgatttccgtgctctggcggtgggcctgattgagacggtggccgaccacgcgatggagctggaggccgacgagctgctgggcgagggcaaccgcaggaacggctatcgtgagagaaggcttcggacggtgatcggcgagatcgtgctgcgggtgcccaagccgcgcgaggacacgtatttccccgaacgggtgatgcgcccgtactcgcgtgtggaccgggcgatggttggcgtggtctacagggcatacgtcaacgggatgagcacccgcaggatcgagaaggtcgcggacgagctggagtccggccggctgagcccgtcgaccgtctcgcgcatgcgcgcctcgctggacggcgaggtcgacgcgctgcgccaggccgagttcgacgccggctcgccggtgcagtacctgtggttggacgcgacctacgtcaagtgccgcgacgacgactcgcgcgtgtgctcccaggccaccgtcaccgcgatcggcgcgttcatggacggcacgaggcgtttcgtgggcttcgacctggtggacaccgagtcgtacgactcatggaagcggttcctgctctcgctgcgccgtcgcggcgtggcgggcgtgcggctggtcacctcggacgcgcacgcgggccttcgccgcgcgatcatggaggtgttcgacggcgcctcgtggcagcgttgcttcgtgcacatgcaacgcgacctgaccgcccgcatcaggcacaggaaggaccaggggcgcgccatgcacgccctgtccgccgtcccacgccagccggacgcggccatgacgcgtgccgcctacgacgcggccgtcgtccgcatcggcgccatcgaccggcgcgccggcgaactgctcgaggacgcgagagaggacgcgctggcccatctggcgttccaccgggaacactgggtcaggctgcgcaccaacaacgtgcaggaacgcgccaacgccgagatcaagcgacgcacccgcgccgtgcagtcttcccctcacgcgagtccctgatccgcctggtcggcgccgtcctcgtcgacatgaacgagacctgggcgacccgcaggttcatgagcggcgacgacatggcaaccgccctgaacccgcgcacaccccgacgcgccgagatcaccgacgagatgcaacgacgcgccgaccagatcatcatgaccgcactcgagtccgcggcatgagcatgtaatcaaaaccaaccgatgccggcgacgacgctgacaccaacatttgaaacgcgatcttgaggagtgtgaaacgcgcttgataatctgctgaaagcgaactatgctcaaattagacaaatgaacagacaatcaatggcatcttagacggttcctctaaaatattacgacgcacagctcccttcgggtcggataaagtccagatggacgtgcattctgggaattctcgtaacgcttacacggaatgcacatgtgaacaggggagtggaaagagagtaggcatggtccgacggcaatgcatctgcggcgcgcacctctatggcctcggccacaccggtccgaacatgttcggcttcatcccgtcgtcatcgctggcgcattacaactacgactgcgaattcaacaccggagttacgctgccgggagggcgaatcctcgagcaatgcgagaactgcggtgccatcgtgctgtgcgagtaccccaccctcgacggttccagacgaggggaggatccactcatcgcctacggtcctggcactgtgtacgaacaatgtgacatcgaatcggtgccgctgacctaccgctcgttcagggcgctcatgtcttcgggcgtcaccggcggcgtcatgtattccgaggcgttcaagacgaacattgcgaagctcttcgacaccgacatcgaccacctgcccagttggaaggtgctgaaggatgccttgcttgattccgagaactgtgcgctcgacgaatggtggcaggccgcgatcggccgcaacttcatcgtgctgtacgagaactccaaggcattgcggcttgtcgccgcatggcatcgtgtgccggggaccgaaattctcaacaccgacatgcgacgggtgatcgaggagaaccgggatcccatgcgtcacacggcctccgatgccgatgagatggaacaggccgggcgggaactcgaaatcagcgatgccaccaagaggcttctgctcaccggtacgcatgcgcgcctgcgtctcatagccaggtcgatgagacttggcaagccgatcaccgaactggctcgattcgtctcccttgaatcgttgatgggcggcaagcagctatgggagaatggtgatgtacgcgagttgcatttcgtgccgttcggcattttccatgccgaggtggccgatgataccgaaatgcacaccgtcgacatcattatgcgtcataatttgctgtcgcgcatgatgtgctcatgcgagcaggcacaaagtctgcacgtatgtcggcatgaggtggccacaatcctgcagttggcccagcagttccggttcgccatagacctcgacgtcgaacatggtgtgtcgatgcgcgagggtgagcatgggacaggcggccagttcgggcattacgccaatatgctcgacgtgatgcgcgaacatgaggattccagggatacctatgaatggctcaccgcgtacattcagccccttgaaagcgacaccggcgacctctatcacaccgagttcatgacgatgccaggtgtgatgagcagcgtgccatacgtggtatatgagccgattatgctcggcttcatcgattccgtgctcacccgatgttccgctgacttcaccaagacgctgcgccgttatgggctcgatgccgatgtggatccgaagatcttgaatatgcgttcgttggacatggaattggtgagcgcactgatcaccatgattgtgtaccgcgaacgccgttccgacgggtacctcgccgaatgcttggagaatggcgtgctcgtcggcctgctcaagcgtatgagggaactcgtggaggaacacaaggggcgtcagtcacggcgcatacgccaataggttgaagccaatgacctcatgcggctgtgggatacacttggggttatgaatgattcgatcagttacaggacgttgcagcgcaccgattacccagcgttaacgaagatgttgtgcgagacgtggcacaagcaggatccgcagatggatgaggatctgcaaatgaagctcgcccagatagatctcgaatactgcctggcacgcacaaccaccgcagaagtggctgtacgcgatggtgaggtggtcggcgccgttctgggtcgcatcgacgcccaggagacccgcaagggaatcaaccagcatcatcgcagcgtcatgaagatcatgggcccgcttttcttcaacaagtcagctcatcaggcgttgaagaacatgctcaacgccgagaaagccgaccggcagatgatcaagcaggcgaagaaggacggccatgcctatgacggcgagatcgtgctcttcattgtgcgcgaggacatgcgcggccagggcataggccagcatctgttcgactggatgctcaatgagttcaaagtaaacaatgtggaacactacttcctgtacaccgacacggattgcgactacggtttctacgaggatcgcggcatggtgcgtcgcatggagatgcccatggaaccccacacgccgaaggaggacaccgaggcgcatcaggaagctgattacctcgacaaccatttgcatgcgctgatgttcgacaacgagacgtcaccagccaatgagggtgtcaatccgctcggccgtgactaattgagaaggcgtcgacatgcatatgagcgaacctgaattcgagcggaccgtcaccgaggcggtccgctccgttccagaacggtttaaaaaagcgctttccaacattgcaatcaccgtggccgacgagccgacggacaaagaatacgtcagcatgacccacggagacggggagctgctcggcctctaccaaggcacgccgatcacccagcgtaccaccggatacgccggcgtgctgccggaccgcatcacgatcttcaagggcccccatgaacgcatctgcgccacgcatgcgcagatggtcgaacagattcgcaagaccgtgctccacgagctggggcattatttcggattcgatgacaagtacctgcactcgcacggctactgatgctggcgaatatacgcaatgacggtggccggagaccttgagaaccaaggtcgccggccaccgccaccttatgcgggactagtcaatggtggtgccgaaaggccacagggcaagcttgcacatcttgaatgactgaatgccgaaaggcacgccaatcaccgtgatgcaattcagcacaccggcaatgagatacccaagcgccatccaccagccgaccagcaccacccatacgatgttgagcagcagcgaacccaccgaaccgccatagacgacgtgttggccgaatggggtgagcgtgagctgggccatcttgaacgactgcacacccaacgggatgcccacgatcgtcacacaaagcacgaggccgaccacgaaccaggcgaaggcgatctccagaccacccagaacaagccagatcaaattaccgatgaatctcataccgacagtgtaggccggccatggatacgcggccaaacgcacgatgtccatcggcgaacatgcagggacctgcacggagacgacatggcgcttcgtctgccgaccatgtgacaatacgaagatgcggggggactcagacgagttgagaacgcgacagcgtgaccctttgaacctgttggctaacacctacgtagggagacatcatatggcgaaatccatgccgaccaccatcaccagaaccgacctgccaccgttcgcgtcgcgcatgcgccaggccgccgatccggtatgggaagagggctacaggcagccattcatacaggaactcggcgctggaacccttgaccgttcgaagttcgcattctacctgatgcaggacgagctctacctcggcgcctatgcgaaggtgcatgcgctcgccgtgacgaagaccgacgaccgtgaggtgatggcatggatggcgagtgttcaggacgcgatcctgcatgtggagacctcactgcatcgcgattatctggcatcattcggcctgaccgaggagaaggtgctgcacggccagcagtccgcattcgcgcgcgcctacacgacgaacatgctcaccaccgcgtattcgggcgatctgctcgacatcctggtgtccgtgctgccctgcgcgtgggtgtacgccgactatggcgagcgactggcacgtgatttcgcacagggactcgagcacaatccatgccggcagtggatcgacatgtacaagaccgacgagttctggcagagctccgtatggctgctcgcgcagatcgaacgccgcgttgccggcgtgggcgaggagcgccggcgtggactggtggattcgttcgtgcgtggtgtcgaatacgagtacatgttctgggcgagcgcctatgagcgccagatgacctggaaaccgcagtgggagggcctcacctcacgctgatccggtatcggcgtgcagatttgcggatgctccgcgcttcgccgcacgcgattgatgtgccaatgaaaacgcccggctcatgtgggccgggcgttttcatccgtaaaggctttgcattcgttctattcgcgcacaagctggatgtgctcgatgtcgtcgcgatgtgaacgacggtagagcacggcacggttgccgatcacctggactacctcggcccccatgcgatcggcgagtccctgtgcggcctccttggcgtctatgcccgagccgtcgagcacctgcactttgatgagctcgcgtttctcgatcgtctcgtccgcctgcttgatcacgttgtcgctcagatcgcctttgccgatctgtacgagcggcttgagctggttcgccatcgcgcgcagctgcctgacctgcttcttcgtcaatgccatattcttgttcctacctttggaaacccggttgtcttacagattccgtgcgtaacagaccgctccatcgtacaggagcgttgggtcaatgcgtgccgatcgcgaggttgggctgaatacgaagacagtcggaatacgcgtgtgagatatgcgctggggttgggcgcccacgggacggggagtgtctcgtcactggatcgcaagcgccctttacgttcctcaacactccccgtcccgtgggcgcccaaccccagcgcaggcaatcagtggcgatcagaagtcgacgtgatggggatcggcaccctgacgttcgccggtgtccatcgcgttgatccgggccatgtcgttctcgcccagttcgaagtcgaatacgtggatgttctgcacgatgcgggtttcatgcaccgacttcggcagcggaatcacctcacgctgcatgtgccagcgaatcatcacctgggcaggggacttgccgtatttgtcgccgatatcgcgcagcgtctcgttttcgaacaaatcactgccccgacctcccatcggatgccatgcctcgaccgcaatgcccttgctgtggcagaagtcgatgagatcctgattggcgaagagcgggttggactcgatctggttgacggcaggcttgatctcggcgagatccagcagctcttcgagctgatcctgctcgaagttgcatacgccaatggccttgacgcggccgtcgcggtagagcgtctccagttccttccatgcctgctgccagccttcgaccggccagtgcagcaggtagaggtcgagataatcgagatcgaggagcttgaggctcttgtcgaaggcctccttcgtcttgccggcgcgaatgtcgtcgttccacaccttcgtggtgacgaagatctggtcacgtggcacgtcggacgaggcgatggcctctcccaccgacttctcgttcttgtagaacgccgccgtgtcgatgagacggtagttgttggccagcgcggccttgacggcgttcaccgtctctgggccttcttcggcgtgccatacgccgaagccgatttcgggcatgagtacctcgttgttcagtgcgatggtatgttcgccatcctgcaatgccatgacttcctcgtttctgtacttgtggtgggcatattctcctgcgtttcatcttaatggccccaaacaatggacatgcagcatcgtgctctatgagaacaaggcggcagtggagaggagtgcggaaataaaaaaccacccgccatgcggcgggtggtcacgactcatgtgcgtcgcctacggcattgggtccttgtgggacgaaccgtgcgtcatacattcgacgtggacggaacggcgctcaatgctattcgcgtcaacctcattcgtcggcgccgccgtgcgcggtgattgtgtcatcgtacatgacgggtgtcgttgtgaatattttgcatgagtattcgttttgagcgtaactacaattcatatggtgaacacattcatggcgattatggccgccaacgtcgtcacggtgagcgtcatgaacacgatgtcacggccgcgtatgtgcatggcatgccaggtggagcgggggcgcccctcttcgaaggagcgtgcctgcagggccaacgacaggttgttggcatggcgtatggcgccggcgaataccggtatgatggtcgcgcacatcgcgttgacccgttgtggcagggaacccgattctatggaaccgccacgaatcgcctgcgcatctcgaatggagagtgcctcctgggccaacgtgggcacgaaccgcagggccaacgacagcaccaatgccgtctcctgcgtatgccaatgcagtcgccgcagcggtgagagcaacgaagagaacgccgccgtcagacgggtgggggtcgtggtctcaagcaggagagcacctaatatcaacacgatggcaaagcgcgtcgtgtagatgatggcgacggacacgccgccggtcgtgatcggcaggggaccgatccttaccaacacatcaccggtatgaacgacaccgatgttgagggcacccatgaccgcgaacaggacaaggaagccacgcaccgaacgcaatagcctggtgaagccgacacgactggcgccccagagagcagccgtcagcagcacacccacagccaactgggcccaggtgttcatggcgaaagccgcacacatcaccgtgaggatgcatacgatcttcacgcgtgggtcgaggccggacacccaggagtaacccgtgtcggtgggggagagtacctcacgctggacctcgccgccgctatctgcgtgagcccgtccctgttgctcattgccgaacaggataacctgatcggccaaacggtccacctgatcggggtcatggcaaatgagaatgacggtgacccctctgtggcgaagattctccatcaggcgctcgatgtgtctgctcgccgaggtgtcgagccctgcacatggttcgtccagcaccagcaccgacggatcgcaggcgatgattccggcgatggcgaccagcctctgctggccgcctgacagttcgaacggattcctgccgcgtaggtcagacacgccgacgaggtccaaagcccaatcgacgcgttcacgcacctgtgccgcatccaaaccctggttggttggaccgaacgccacatcgtcggccaccgtttcggcaaatagctggcgttcgggatgctgcatcacaaatccgagcactcgacgcaagcgtctgcgctcgcgtcgtctcgcttgcgtcacgtcgatgccctccaccacgattcggccgccgcgcggtttgtcgagcgcgcacagcagacgcgcgaaagtggtcttcccggatccgttcggacccatgatggccgtcaggcatccgcgtggaatccgtagattcatatggctgagcacatccgccgattcccgctcatagcggaacgatacgtcatcgaacaccacagcggttggtgccgccccgattattccggcatgctcggtgttgacatgtcgggccagggtatcgagctgggcgaacgtggtcacactgggggaatgatggtcgtgttgcggcatgtgctgtgcgcaatcctcaccggtgattctgccgtgctcgatatgcacgatgcgatcggcatgccgtagttcctcgggcagatgcgagacaatcaccaaggtcgtccccgatgcctggatgcgatcgagtagcgccagcacctcggcgcgcgcctgcgggtcgagcatggcggtgggttcatcgagcactagcagacggctgtgtatggcgagcatgccggcgatggcgatgcgttgttgctcgccaccgctcatatgtgtggggtcggccccccatgctgtgagcatgtcgacacaggaaagtgaggcatgcacccttgcgccgatcatgttggcgggtacatcgaggttctccgggccgaatgccacatcgtcggcggtcaccgtcgtgacgatctgatcctcgggattctggaacaccgcgccgatgccacgtcgtgcacatgcgtacgcatcggcgtcggcgccaccttcgtcggtgaacaccgtgtgccccaagagcgtcacggaacctgtgtcgggcgcgctgagtccggccatcacacgtaacaatgtggatttccccgacccgttcgcaccgacgatgcacacgcgttcgccggcgcgaatgccaaggttcacatcgtcgagcgcccatgtctcaccgccgtcataggagaatccgacatgccgcagctcgatctggaatcccgaggcgttcatcgggcgatcagcttgcagaccgggcgatagcacaggaagctcacgacgccgttgattgcgaatttgagcagattgaacggcagcagaatcggcacgatcatcgaggcgacttgctgcatgctcatgtgcgcgtagagcggggtgatgaacagattgcctacgatggccgccgcgagtgcgacggcggcgccgaggaggatgccggtgagtgcgcctgtgcgtgtggaacgcctgcggtagatgaaggcgaccggcaatgaatacccgagtgccacgagaatcgccatcactgcgcccagcgggttgacgaacagatgaggcacgaacccgagcacgctgactatgaccgcacccgaggggccgaatgcgaagcctgcgagaatgcagacgatgcccgatggatcgtatttgagccaaggtgcggcaggcatcaacggaatctcgatgaaactgaccgccatggcaagtgcgacgaacaacgcatacatggcgatgcgctgcgtggaccagcgtccgcggtctgccgccccagtggagtggctgccggagacctggttgggtgaaatcgaatctgggtgtgaaaaaacactcatgcgagctcatttctttcatccggactataaccgttggccctggactcgcaccagatccaccgcttgcgcgggttgcgggctccgcatgcgggcacgggcccgttgcgctaccgccagtaaggagtttcaccttccctgaaattgcactacctatgtatagtccaccgcacggatttgcctgcccattgtccacaatatgggcgatatcggatgggacgcggcccagatcggacgcctatttgttaatgcgatgtattagtatgagttcggaatgaatcgccagaacggcaaacgattgcttcccagtgcatgccaattgcgtaccatataaggaaaaccaagctatccagcgttttcatgtccgacaaatacgccacaatatggggtatgaggcatgcaacgagtgcacgcctcggattcgaacggcaagggagattgcaatgattgacactgcacaagcattcggcgttgacatcggtggctcgggcatcaaggccgctccggtgaatctggagaagggcgaattcgccgaaccccgcctgaagatcctcactccagagcattccactcccaaggctgtgggagacattgtgcgccagcagctcgagcatttcgaagtgcccgaggacgtaccggtgggaattgcgttcccggccccgatcaagccgggtaagaagctcgacttcatggcgaacctcgatcagtcgtggattggtgtggacgtgaccgaggtgttctccgaggcatgcggccgtcctgtcaccgtggtcaacgacgcggacgcggccggtctggcggaacaggcgttcggtgcggcggcgggccaggatgggcttgtcatcgccaccaccctcggcaccggcatcggtaccgccctgatctacgatggcgtgctcatccccaacaccgagctcggccacatccaactgccgaagggcaagggcgatgcggagaagtatgcggcatcctcggtccgtgagaaactcgacatgggctacaggaagtgggccaagcgcctcaccaagtactacggtctcatggagctgtacttcagccccgagttgttcgtggtcggcggtggtgtgagccgcgtctccgagaagttcctgccgtacatcgacatcaagaccccgattgtcgccgccaagctgcataacgaggcgggcatcgtgggtgccgcctactacgccaaccagcagtcggccaagtaggtcgcattacattcatgcaagactcgaggcgccatgggattccatggtgcctccagccgtattcgccctgttatggacgacgctgggagtagtattatgccgtgcgtttttccagcagaatcgatgtgagccagccgaatccaatcgccgcatgcgaagcagaggccaaggctcgtggggtggacctcgacaaactcaatgactcgaatcccacggcgcacggccttgcgccgcaattgctcccgcaggtgtatcgggcacagccacgtggtcagatggaggcacggcgtcgccttgccagggcaataggatgcccggatccggagcgactgtatctgctcagttccacatcgcaggcctatgcatggctcatgatgttgctatgtgatccgggggaggcggtgctcgcgccgaaaccgggatacccgctcatcgaatcgatcgcacggctgtgcggagtgaagacggtggaataccagttgcaattcgacggttcctggtacatggacatcgcggcattgcggaccatactggaacgggacgggcaagcaggccggcacatccgtgcgcttattgtgatcaatccgaataatccgaccggccaatacgtcaaacccagcgagcgggagcatctcatcgaactgtgccgtgagttcggcatcgcactcattgcagacgaagtgttcttcgactatgcgttggagccattcgagggcaataggagattcgcgggcgagcgccgtgtgctcacgttcgcgcttgatggtttttcgaagcgtctcgccgcgccgcacgccaaggtgggttggatcgaggtcagcggtcccgacgacgatgttcgggaagcgatgcgccggctcgatgtgatcgccgatgacttcctgccgatgagcgagctcatcgccgaacgcatggacgacatgattgccgaactcgacagtcagcatgaccgcgtgcaggagcgcatctcacggaatctggaatcgctgcaccggctgctcgatgcggacgacctgggcgtggtgagcgtgctccgtgccgaagggggatggaacgtgctgctgcgcttcccctcgttcatcgacgagaacgagctggtgacgacgatgattcgcgacaatgccacgtccggccagcccggctatttcttcgacatggaagccaatgggtatttggcgatatcactgctgccggtaccggatctgttcgacgcgcatgtgcgtctggtgctcagtgccgtacgtcactgtgtcgaggagatctgacggtatttgctgcggatgagctgtgcatagtatgccgatgcactcgccggttcgccgtcgaatgcaatctcgccctcgtccatcacaatgacacgcgtgatgttgaattcgtcattgcgaatgagatcgacattatgcgtggcgaagacgaccggcttgccacaggtgaacagacggtgcgcgacatgccgtgagctgatctcatcgagtccgcgcataggctcatccgcgagcagcacacctggattggcggcatatgcgcgggcgatggcgaacaggtgcaactgctcgccatcgagttcgtcgagcggggtgcgcatgttcgtatccaacgagaacttcgcgagtgcgtcaccggcgatcgcaagacgctgtacggtggtgagccggtatttcctgagcagctcatcgatggattgctcgatgctcacattgtgccgcaatcggtacaaatccgcctcacgctgcacggtgcccacaatacgttggatctgcgcccggccgccatgcgacgcatcgtagctcttgccatcggcctcgacggtgaccttcccggaactcggagtgagtgtgccgttcatgagatcgatgagtgtggatttgcccgctccgttgagccctatgatcgccgtgttgccatttgaacatgacagatcgagtgagatgtcgcgcacgccgtatgtctgggcgtcatatgcgtatacggcgtggtcgaaaccgaacccgaccttttgcggcggtgttacgggtctggtcgttttgaacagcgatgtgagcaatcccatgccgaacattgtagtctgcaaatgtgcgcttgcgtgcctatacgcagaacgaacagcggagggcgtccgcatgccacctcacggcagcaacgtgaaccatgaacgcacgtcggcgaatctcgagggcatgatgttgatcatggcgtcatcacgaccgatgacgaacatggaggccaatgcgagcatgatggcatacaccagcacgatgacgaacaccacacgccatgcgggatgccgttccacaagccatgccatcaccgccaatgcgcacagcatgacgagccaggagaaatccgccagataccgccacgcgaacccacccacataggcatcgaacacgagcaacaccatggacagggcgagcatggatgtcagcgtggcatacagtctgccgagcgggcgtctcatgaacgggacggcgaaggccaacagggcgagtggcatcagcacgaacaggccagcgggcgtcgtctcggtgaagaaccagatgggcgtcggcgcgggcgtaagctcaagccatgggaagtcattgccaaaggtgagcggcagaaacaggtagcagcacaatgcgcgcggcatctgcgggagcggtgtgtggaagtcggtcatattcgccacagtgatctggtaagcgttgccgaaatcggtgaacgagccgaaacgcatagcgttataggcaatcaccggaaccacgatgagcatggcgggtatgatgagcgcgcacaggaaacgcaacgcctgaatgcgagtggcgcgttcccgccatgtggatgcgctgaacaccgcgcgcacctgcgggaagaacagggcaatggcaagcaatgccgtcaatgcgaaggtgggacgacagccgatggtggcggcgatgcacagcgcgcctaatgccacatgcagaagactcaatgaggcggcatccgcggaatcggaacggcccaacgtgcatgtgcgttttcgcgcgaccggggcgccaagccaaagccacattcccaggaaggtcaggaacaggccggaggcgaagggaatcgaatagaaattcgtgcgatgccagaaatacagcaggttcgaaccgagcacgaacgccagacaggagagcgcgcaggtggccacgctcacctgcaccggcatgcgtttgagcaggcggatcaccagcaaacagccaaagacggcggcaccgaacatgagcagcaggtcggcgctcgcattcggcaacatgaggccgccgggaacgaacagcgaggtgatggcacgatagggcaggaagagcaacagcgcaggcagcacaccgaaataggaataccaatggccatcgtgatatgcgtaatcccagtagatgtgcgtcacgccctgctcgagcagacggtcacgcgcagccgtgtcgtagggattgcgcagttgggcgaactgttccggcacgggaaggtcgagccatgcgtggccgttcataagggcctgtgcgacatggtcgtattggtcgtagtcgtaggagtatcggcccggaatgtgataggccatcggtgcggccccggcgatctgccagtagatctggacagccgtatagccggcgagagccagcgccccaatggtgaatgcgccgcgttgcaatcgcgaactggtgtcgagtggaatgagccacaggcggcttctgggcgagaatgcgatgagcaatgcggcaaacgcggccatgagcagcacctgcgcccagttccagctgaacggtacgcgtgcgttggcgtcaagccccacaatcggtatgagggaatcggttgcctcctcaatccacaggcgcaccgtgtggtcaccattagactgcgcatgccgggtttcggaatcctggtagggcaggtaggtggagcgaggggcatcgacggcaacggtctgcatgcggcctccgtcaagccgcacatgcacaagctcgcggtagagctcgtcacgttggacttgggtcatggtcgttctggcgagggcaatgtcattcagcgaggtcatgagcacctgcgcgtagggtgatgagccattcgtaggcgcatcaatatatgccttggttgcgtcggtgacctgcagcaggccatcgccatggattgcgagacccgggccgagtgtcacctgagggtcggcggcgctgttcgacccctgttcgatcaacgattgtgaggcgtctgcaggcctcgcggagcgtgagcgcaggcatgcgaaattgaatacgaggcattccacgagcacaatgacggttgcggcgacgagcgcggcgatgaacggatgggtccggcgtgcaggtgtgttcacatgcgtcattctaacggcatgcgagtaactgccgtgaccttgtgcgggtaatcggcagacatattgcgccttgacgtgtagattggaacacatgacaggcacgaattcaaacacttccgacccacagccacgcaagccggcgcggtggctgaggaacctgggtgtcaatgcggccagatatgcgcgtcaggtggagtcgacggcgcagagcatgttcgccggcgcattgcccacgcacaacatgttcacgccgactccgacgaatccgctacttggcgtcaagatgccgtcagcggagacgatcgtgcttaatccgttgatgcgccgccggtcgttctcggtggctggaacgggactgccattcgagcgtgtcggttgggtgcagatgcccggcctgcgcagattcgccctcggctatttcacctcgcatgaccgtttctgcacgctggcgatggccgatgacaccggcgccgtgtatatgaccggcgacctgtatgcgaacctcgatgcacgcgaaccggatttagagcttgacgtcaccgattcactcacgaccgatgacgattcccgcttcggcgggacgaaaccggcacacatcgccaccgtggaaggatccgcacgggcacttgtcggcgatatcagggggcgtgatggcaacggacgcatggtctggctcgctcgcttcctcaaatcggcgaatcggtatacgatcgaaaacgcccgtgccgaattgcctgcgcgccttcgcacggatctcgaataccgcgatctcatggccgtgtgcttcttccatctctaccttgcagtgtcggtcaatggcggcctgcaggggtatggggccggcaacatcatttcgaatttccgtcgattctcaccgctcgcagccattcgcaccagcgtgtcacagacggacacggcacgtgcgcaccgcatgcgggtgagcggtctcgaggagtacttcgccgacacgatgagacgcataggtgtcatgggtgacctgtccgaattggaggcagaccatggcagtgaaccgctgtatatgattgaatcgcccgtctcccatgcgcgtttcctcgtatgggagaagcgcatgccatatgatgcgatgcttaccagcctcaagctcgagggggcggtcaaccggttcctgctgatcgacaagtggctcgattacaatgccgcccacagcgaacagccgatcgaagataccgtgacgttcaagcaggtcgcccgcatcgaccgtcgtctgttgcgcaacccgtcgctgtccgccctgccgccgacccatcctgtgcatattctcgacgaccccgaatgtttccgtgtagacgattacctgcatttcggcaggggcatgtcgctgtccgcgtcgctcgacgcctcacaggccggcgttggcgttgatgtacggcatctcgtcggcagcgaatggatataccggcacgcccttgcaaatgcagtcaacgccctatggcttcctttcagattcgacacggatttccgttcgaacctgcaacaaggtgaggtggcattcgccttcacctcggcaagccgcacgctcatgcccgacgagctcatcaacatgcgatccggcgccatggccgaactcgatgaggccgagcgttcacggatcagcgcggaatacaatctgcagatcgggctcatcttcgcctccctcgcattcggtgccagcgagcagatcagacgcgtctcgttgcgcatggattccctcgggctggaggaggccgtctacgaacgcgacaatgccatcaagacgctcatggacagcgcgatgacgcaaatctccgatctgacgaatcttgaggatttcaccacgcacgccggccagggaagattcggcgaacgcggcagcgccctgttctccggctcggaagaaacctcgggagtcggcgacgatgagcatgatggggttcagacgcaggccatgcagaccgatgccgacttcgaccgcgaattgcgcgacctgctcgagcacgacgaatccacgtcgtccgatgatacgacgacgcatcatgccgaatcggaggacgacacggtgcaatccatcctgaacgtggatgaggaattcgaccgattgcgcaacagcaacccctccataaaacacctgctcaccgtcacattcacgcgtgatgaattcatcgactacatgcacgccaacagctgtgccgacccgttcgccgtatacgacgcgttcggcgcgcaatacgattacgatggcaccgaaggattccgaccggtcgaaccaggcttcagcatggacgacacacgcttcaccggcgacgcggcctacacgattccggaacgacgcgacaggcctctcgatgcaacagtggcgcgatcactgggcgcacacaatgtacgcgacctgtcgatctcgcgagaggaaatgttccggggcaccctcgaactcattgcggacactgcgaagaacgacggcctacgtgccgaccggaaggccacctatgcaatgggcctgatcgagcagtgcgcagatcccgaactgcgcaaccacgccaccgagatcaccaccgcaatcatcgacggcacccccataccgcagatcaccagcaccgtggagagagcactcgccgacgcacgccgtaaatcacaggagatggtgttctccggtgatgaggagggggcaatcgcgaacatggaacgcgtgatcggcgaactcgacgagatgttcgaatcggacggcgtggtgccgcgctacttcacctcctacaccgaccgggtggtgtacaaccggctgttcgccatgccggacgagcgcatcgccctcgtgcccgatgcgctgttccaagctcatctcgacatgggcgaagtactgttccgctatgacaggggcgaggaggcgatggcccacctcaataccttggtgagatacgcgcccgccaccgctggcgtacacatccaacaggccatacgactatgcgtctctgaggattggaactcggtgcgagcagccgcactgaacgcgctgcgcgtagcctgcgacccggtggatgccgccaacgcatactactactacgtctgcgccagctggatgaaaggcgacaccgccgtcgcagtggcggccggcaacctcgccacgtcgctcacccagaacctcgcacccgcgcaacgtgccaggctcgaacgattccgcaacctcgccatggcacagggcgaacagatcgcacagaccggtgcccaggccgtcggagtcctgatgcgacatgacgtgccggtgtggccgcaggtggaatgcgcgcagattattcgcgacgctgccttcaccgccaccaacgagaagatcttccccgtggcacaggcactcaacgtgagctggtatgcgctgcagggaggtaatctgggcccgggaggcatgcagttcctgcgctcgctgaatgcgtaggacgatggtatacggcgcgtccggcaccctctctggtgcgtagatgcgtaggattgaccaatgggccaagaccgtggcgtttcggattgggtaggatttggaggaatccggttatggaagatgcattgattgcagacgagcagctcgacaggtatccgattggttcggatccgtggattgactcattgcgtgacatcgacagtgatgcgatggaacttgatgatctcgacgtgtcgaagctcaatgtagagcaggcggtgcggctgtggtcacgtctgagtgcttgggtggagggcgatcaggtggcctattacgtcaaggacgccccgctttcctccgatgcagcgtacgatgcgcgcatgaattgcctcaaacgactggagtcggagttcccccagcttgacacgcctcagtcaccgacccatcgggtaggtggcacattctcgaacgacttcacggcggtgcggcacccctcccagatgatgagcctcgatgatgtgttctccttcgaggaactgcgtgcctggtacgatggcgtgcgcaaggacctcgaatggccggaagacaagctgttgcccatgacctgcgaggtgaagatagacggtctggctctgaatctcatctaccgcaacggagttctgacgcagggactcacccgtggtgatggggtcactggcgaagacatcacgatgaatgtgcgcacgatacactccatccccaccaatctggatggcccggagggcgatattcccgatatggtggagattcgcggcgaggtgttcatgcggtgggatgattttcacaagctcaacgaggcgaacgaagatgcgggcagaccaccgttcgccaatccacgcaatgcggccgcgggatcgctacgccagaaggatccgcgcatcaccgcgcagcggcatctgagtttctatgcacatggcatcggcgaactggtatgggggtcgggcaagccggtggatgtggccgacgaggtgaggaaccagtcggatgcctacacgatgtaccgcaaatggggggtgccgatttcgccccataaccgcgaggtcaccgacttcgaccagattctcgacatgatcgaatactacggcgagcaccggggtgacatcgagcatgcgctcgacggcattgtggtcaaagtggacgacctcgcgttgcaacgcagactgggcagcacctcacgcgcgccgcgttgggccatcgcctacaaatacccgcccgaggaggtcaacaccaagctcctcaatattgtggtgcaggtcgggcgcacgggcagagtcacaccggtggccatactgaacccggtgtatgtggccggatccacggtgtcgcgcaccacgctgcacaatgcatacgaggtcaaacgcaaaggcattctcatcggcgatacggtggtagtgcgcaaggccggcgatgtgatccccgaactggtcggcccagtaatcgccaaacgcgaagggcatgaacaggacctacgcgagttcgtcatgcctacacgatgcccatcctgtgacaccgtgttgcggtatgagaaggagggagacaaggacctgcgatgcccgaattcggaaagctgcccggcccagctcgccgaacgtgtgatcaatctggcggcccgcaaggcattcgacattgagcatctgggtgaccaaagcgcggtggcgctgacgaaccccgaagacaacaggccggactcggtggaagcctacgcccccggcgtgcgtgagatcgtggtggaaccaggcgaggagccggcaccgtatctggctccgagcgggctggaacttccgcccatccaggagcccgtactcaccagtgaagcgaatttgttcgacctcgaagcaagcgacctccgggatgtctatgtgtggcgtgaagcgcagatcatcgaagtgcgcaggcacgtggattcgcatggcaaggagaggaaggtgcgccatcgtctcggcggttccggcctgtggcatagggagccggctttctggtccggggtcaaggatgccccgctgaagaaggacgcgaatcgcaagacggtgaaggactccgaaggcaaccccgaatacgaggtcaaaccggatgccgtgattgtgggccatggcaggaatgggcggccgcgcatcgaggaacccaccgagaacaccaggaagatgctcgatgagatcgagaaagccaagcataccgatctgagccgcgtcctcgtagcgctctccattcgccatgtgggcccaccgaccgcattcacgctggccaagcactttaagacactcgatgcgctggccgacgccagtgccgaggaactcgaacagatcgacggcataggcgcggagatcgccgattccattgcgacattcttcgaggaggctcgcatgccgggcaattggcgcggccgtgtgctggaggcgtggaaagccgccggtgtgggcatgagcacgcatgacgagggtcttcctcagacgttggaaggcaagagcgtggtggtcaccggcacccttgagcatttctcccgcgaatcggctaaggaggccatcgaacgccgtggcggcaaggcctccggatcggtgagcaggaagacggattgggtggtcgtcggagccaatcccggttcgaaggccacgaaggccgaggaactgggcatcccgatcatcgacgagcaacagttcgacactttgctcgccaccggcgacgtgcaatgattcggcgtccggacaaggcgatggcatgtgggcagcgctgcaattgcacgctgcccacatgccagtttgctatgccagaagactcttggccagatgtccgaaggtacgaccgaagtcgtcgtcgcggagcgtgccgtcatcattgagcacggccggacgtccctcgctttcgccgatctcacggatacgcgggtcgagcggcaattgcgccatgagcggcacctcatagtgcagcgcatcggtcaactgggaactcacacgagctccgcctcccgtgccgaatatgtcgatccgttcgcctgcatgctcgaaatagctcatgttctccaccacgccacgcacccgcatcggcacctgaagtgcgaccaggccggaacgcacggcgatgtccgacgcggagggctgtggggtcgtgaccacaacgagctcggcgttcggcaatgcctgcgccaccgaaatcgccatgtcgccggtgccgggggcgagatcaagaatcagcacatcgggttcgccccaccacacatcggccagaaactgttcgagcgaacgctgcagacgggggcctcgccatagaatggcacggtcggaaccggcgaacatgccaatcgacatgagtttgacgccccacgcggtcaccggcatcagcatcccgttcagattcgtgggctggtcgtggacgccgaagaggcgggggagcgagaagccgtagatatcggcgtcgatggccgcggtgtcgtagccgagtgcggcgaacgtggccgcaagattggcggagatggaagactttcccacgccacccttgcctgaggcgatggcgaagatgcgcgttttcgtacccggtttgctgaacgggttctcacgacgggcggctttcagatcgttcaccagcgacttgagtttctcctcatccatcgcgccgacgacgatctcggcggtgagctgcgcctcggcataactggtcacggccgcctcgatctgcctgctgatctcggcagacagcgggcagccaggcacggtgagctccacattgacccgcacattgaaggaatccaggcctgtggggcgaacatcgacgccgcagatcatacccagatcggtgaccgagcggccaagctcagggtcgatcacgtggctgagccgctcaatgacggcggtttcgataatctgcgtctgatcagtcatgccatgcctttctcaacttcaaagaaatcggtgtcacgatcaacgccccactatattgcataacctcccaacgcgccagagattgcacagacatggtcattggcggcagagccaccgtatggcgtgcgaatcaggcacgcttcgcctcactgtcacgaacacgccagtgagcgaactgagccaaggctccggtgcgggcgatggcacgcgacagcgcgatgcacgcagcggctgcgatcacaccgcccaccaccgaggtacccaaatagatggagacccgcatcattccccaccccgggttcgtgaaccagtagtagacgccgcacatcgctccggacaatgccccggacagcagcaccacaagattggtccacaccttatatgcgaagagcgcgaaagccagttcggcgccgagcccctgcatcagacctacgatgagggagcctcccacgccccattggttgccgagcgtgagctcgaggaacgccgcaaccgtttcggcatagagtgcggcacccggcttgcgcacgatgaccgcggctaagggacctgcgaacagccagaatccattgagcagtccctcgaagccgggtgtgatgttctcgaataatgtgagtggtgccatgcacacccagtcccacatccagaacaccacaccggatgcgacggcgatcaccgaggtgacggtgatgtcgagaacacgccacttgcgcgagcttgcttgtgatgggtagatcatattgtgcctttctgagatatcgaaagacacgggaaatacgacgtccgtgcgccggcattatccggttcacgttcatgcggtcgaagcgttcgcttcatctcagcctgccaagcaagcccccgtgtctacatcgatcataggcacaagccccgaatttgcagggcatgcccgtccgcataacggaaaaggtgggtgcacgtatgcgcacccaccttggaaatgccagtattcggcgaatcagatgtggaagtagagctcgtactcaagcggagtaggctgcaggcgagcctgatcgatctcgccgcgcttcaggtcgatccacgtctcgatgagatcctcggtgaacacgtcaccggccgtcaggaagtcatggtcctcttcgagcgcatcgagggcctcggcgagcgaggacggcacctgcttgatgccggcatgctcctccggaggaagctcgtagagatccttgtcgaccggctccggcggctcgatgtggttgagaatgccatcaaggcctgccatgagctgtgcggagaaggcgaggaacgggttgcacgacggatccggcgctcggaactcgatgcgcttggcggcaggcgaggtgcctgcgagcgggatgcggatcgcggcggaacggttgcgggcggagtagaccagattaaccggcgcctcgaagcccggaaccagacggtggtaggagttcagcgacgggttggtgaaggcgagcaccgacgaggagtgcttgatcagcccgccaatgtaccaacgggccatgtcggagaggccaccatagttcttctcatcgtagaacagcggcttgccgtccttccacagggactggtggcagtgcatgccggtgccgttgtcgcctgcgatcggcttgggcatgaaggtggctgccttgcctgcgagagcggcggtctcgtggatgacgtacttgtacttcatgaggtcatcgcctgcatgctgcagggagttgaagcggtagttgatctcctgctggcctgcgccggcgacttcatggtgtgcacgttcgaggatgaggccgaccttctgcaggttggcgaccatgtcgtcacgcagatcctgggtgtggtcggccggtggaaccgggaagtaaccgcgcttgacacggttcttgaagccgatgttcggagtgccgtcttcctcgacgtccagtccggaattccacggtgcctcgatggagtcgacctcgtagaaggagccgcgcatgtcgttgccgaagcgcaccttgtcgaagatgaagaactcggcctcgggagcgaacgatgccgtgtccgcgacgccggtggacttgaggtatgcctcggccttcgcggcgacctggcggggatcacgggagtaaggctcgtcggtgagcgggtcgacaatcgagaaggcgacgtcgagcgtcttgtgcttgcggaacgggtcgacgaaggcggtctcgatatccggaacgagcttcatatcggattcgttgatggcctggaaaccttcgatggaggagccatcgaagggcatgccctcatcgaacgcgtccttgaggaattcgctggcaggaaccgtgaagtgctgctgaacgccaatcagatcggtgaagcgcacggaaacatattcgatgccttcctgattgacgagagcttcggcgtctgccttggttttgagtggggtcacgggaccgctcctttcacgatgttgcttacgttccacaagcatagggactagcatttcgcccactcgtaatttgagttaacaacatgtttcatacgtggactaacacttcgaaaacgttgtgtttccaatggttttcaaatagtggacacgtgctgttccgtgtcacattccaaatccgtgccactctcggggctcgccggttttcggattcgcatgcctcacggagccgaaggcccaaaaagaaatcccggccagatggccgggatcgtcgaatgtgaatggctcacctgccgcgtatcgcgcgacggctcaccttgtgcgtcttcatcgggtccatgcccttgggaatgcccatgccgctacggcgctgcagtgtatgcaagcggtcgttcagtgtgatgagctgcggtttggagagtgcgaaacgatggcgcggatgaagcttgcgcatgattggattggtgtagttgttcggcacgtacgtcttcttcttgagcaccgtattgcgcagatccttgagacgaacctgcttgggaccgtctcccacgcagatgcggtagacgggaatatgcgaacccgcagtcacgcctttgatctgcttttcctggcggtccatcgcctgcatcacgcgaccgtaattgccttcgccgatcaggtagatgccctgatacccggtgccgcgccacactgcgtcacgggtacgcgggtcgacccacaccggttcctgcgggaaatcgaatccggcgcgcttcatgttgccgagaatgctgatcgcggcaccggacttgccttccatctgcttgtacccgacattgtcggcacggcgggtgagcacgatcgtgaacagcagcaatccaatcatcacggcgagaatcatcagcgtgatccacgagacccaaccccaatggaacacgatgccgcagatgatgcccacgacgatcggggcggcgaacactgcgccggtgatccatggcagcgccttgtcctcggctgccgtgaacttgtagatcgtgacgatctgctcgaacattccgcgtttctttggcttctcagacttctcttgctgcgccatgtatccctctctagcttgtttcaacacgaatacgggcaatgtatttactgtatcagcatgcgctgtcccaatgtgacggttgcgtatccggcgaggggtcagcgggtgtgcaacggtcggccatcggctttgagcagcgtttccccgagcatctcgctgaaggtcgggtgcgggtgaatgttgcgcgcggcagcgctcaatggaacatggttgcctatgatctgctgtgcctcggcgatcagatcgctggcgtcgggggagacgatatgcacgccgagcacatgaacgtcatccgattgatctgcggacttcttcccgctcaccaccgacactgaaccggatgccccgctcatcagcatgcgcgcgttcgacatgaccgggatgagcgtttcggttacgtcgacgagctcggtgtcggccttggcttcgcgcagcgtgtagccgacggaggcgaattccgggttcgagaacacaacggttgggatcgtgtattcgtccaccggggagggatcgagtccggcaatcgtttcggccaccacatagccttgttgatatgcacggtgtgccagttggtgccctggggtgatgtcgcccaacgcccacacatgttcccggctggtgcggccgtaggcatccgttttcaccaaaccgttctcatcgagctcaatcgatgccttcgcgaaccatgcgccgtcggtattcggcacacgcccgatggctgcgagcgcccactcggcgaatacctcctgcccgttgccgtctgcgtccgtgtaatgcacggtgacacccagattctccccagtgtcgaccgccgtgatggcagcgttcgtcacgatcgtgatgccctgtcgcttcagttcgcgcatcagtatcttcgcagcccgcctgtcggagcgggagagcacgatgtcgccgcgcatgatgagcgtgacgtctgctcctgcggaattccacatcgacgcgaattcaagcgccgtggcccccgaaccaatcaccacggcgctgtgtgggaaggagttgagtgccagtgctctcgtcgagtcgatgagcacatgattgaacggcgccacatcaagcggtttcggccgtgagccggtggcgatcaccacatcgcctgcggtgacgtcgagagattgcccaccgtccttgaaatcgccgtctgcagtgcggatgcggatcgtttgcccgccctgtgccggtctcacatggacatggccgtcctctacaaccgaggcgatgccctgcaccatatgaacgccgcggaaggtgagcagcgcgagcagtccgtcgcgcatcgtcgagaccgtgccatcgcggaacgcacgcagtttgccgaagtcgatttcctgcagctcgcagtctatgccgatctgttcgccgcgatgtatcgtgtcaatggtgcgcgttgccgtgatgagtgccttcgacggaatgcacccgcggttgaggcatgtgccacccaccacatcgtcgcgttccaccaacagcactgatttgcccagttccgccgagcgcagcgccactgtgtagccgccggggcctgcgccgataattaccacgtcgtaatgttcactcgtcatacgcttcgttcctgtttcgtttgttcccatgcacggcgacattggccgtcatgcacgctgcatacagattactcgcccagcccgcatgccacaagagtgcaacaggtgcttcgggggatctctttggaaaacactttccgtgggcatgtgcaaggctggtcgtaatgaaggaggggaacgcattgcgttcccctccttgtatgtctcggatagggtgcgactactccgggaaatgcccgcgcttggcatagcgtggtttgggcaggcgccagcggcggaactggatggaacggctccacgcataggatccggtgcgcatgccgcgtgccaccgactgctcgccgtacttggcgatgagcagtttcttgagcttgcgccacatcaccacctcgtcgatgacgatggcgaacaggtacaggtatagcaatgtcatgatgataatcgacacgagcggtgacgggaagatcacggtgaagatgaccgaggcgacgagcatgaccaatgcgacgggaatgaagtattcgccgatgttgaaacgcgcatcgatgtagtcgcgggtgtatatgcgccatggcaggcgttcggccttcggcatgttgttgaggtcgccggtgcgcatcgcctcgtactcgcggttttcacgctcgcgcagcttctgcttggcgagcttgcgctgctccttggtgttctcgggaaccaatgggcgcagattccttgcctcggcatccttgcgcttgggggtggggcgtcccttgcccacggtcggctccgcaggggcctgagccacgtcctgcttgctttccgtctctttcttcttgaacaaagccataatctgctagggtacgggcaactctcgacgcgaaatcgtggggaaagccgattacaatggcgttgcggaaccggatttcacacaatttggaatcctcggaaaggacggacatgattttgacagcagatcagattcgcgcacgcgtggacgccgattggccgcagattctgggcgtggtggaggaccgcatcgcattgcgtcccatctccgcgcatggcatcaatggggagcatatgcgcaaatcggcggaatatgtggcgaacaagcttcgcgaggtgggcgtggacgccaaggctgtgcaggcgcgtgacaaggacggcaatccgagcgcatgggaggtgatcggctctctggaagtcaatccgaacgccccgaccgtgctgttgtacgcccaccatgacgtgcagcctgtgcccgacgagaaggaatgggataccgcaccctttgaggccacattgaagggtgacaggctttatggccgcggcgcctgcgatgacgctggtggcatcgcgatccactacggggcgctcagggctctgggcgaccagcttggcgtgaacatcaaggtgttcatcgaaggtgaggaggagatgggttcggcgagtttcatcccgttcatcgaagcacatcacgacgaattcgactcagatgtgatcatcgtcgccgattctggcaactgggcgccggatgtgccgtcgctcaccacgagcttgcgtggcaacgccacctgcgacgtgcatgtaaaggtgctcgggcatccggtgcattcgggacagtacggaggcccggtgctcgacgcgaacacactggcctcgatgctcatcgcgaagatgtatgacgagaagggcgaactggcaatcccggggcttatggagggcgagccgatcggcggcctgcagcgcgatctggatgaggccgacatgcgtgcggccgccggcgtggtcgactcgttcacgttggtgggcaccggttcgctggcgtcacggttgtggacgaagccgagcgccacggtgatcggcttcgacgcccaccccgtcaaggactcattcaatgtgatcagccccgaaaccacattccgggtgagcctgcgcgtggcgccgcaacaggacccgcacgtggccatggacgcgatggtggacttcttcgagaagaacgcgcccttcggcgccgaggtgcacgtcgaaccgttggaagccggtatgggctgggccatgaacccagactgcgaggccacgcaggacgcgctcacatcgctcaaggaggctttcggcatcgacccggtgaacaagggggagggtggctccatcccgttcattcccgaactgcagaagattttccccgacgcgcaggtgttggtcaccggcccggaggacccgatttcgaacgcgcacagccccaacgaatccgtgagcgtgtcagggttgaggaaggacgtcgttgccgaggcgctgctccttgataaactgggcagagcataagtccatgccctgtagcggcaaatgagaggagacgccatgtcggttgtatcagcggtggtttcggtgttgttcgcagcctcgacgcaggtcgggtcaccggtgtgcgccgacatggtctggtcttcccgggtcaatgttctcctagcgaccacaacgaccacaatggccgcaatggccacaagggagtgccctgcttggatgcatgcgttgggttggtgctgatgcatctggttgcaccatgcagaaacgcctgaagaacatcgcccacccattcctcgcattcatcatcgcggcattctccttggtcttcgaatgcgatgtctggttgttcacaccaccaaaacaatggtggttcatcagtgtacttatgcttgcgcaggcgctcgccatcagctgctactggtcaccggtctggtgttcggtcgcactgcttctgctcaatggcgtaggcgaatacgccatttcggggtatgcgcagttcacatcgtacttcatgttcctggccgtgatactgatctgctacaagacgtccaatcgcatcgccgcggcactatgcctgctgatgatgtcgtacacctgcctagaaacgatgattcgaccaggatcgttcaccggctacgggtgcctggcgttctgcatgatctatgccgtggcgtcgacgatcggccgatacatggcatgggagcagcgacggatggagcgcatgcgtgagagcgtgatggtcgaaagccgcctcaggcaactcgaggcaaaccagtatctggccgcatatctgcacgacgcattgtctcaggagttggcgctcatctcgatggagacgcagctgcacgccgtcgacaagagcgtgcccgacgaggaacgctggcggcgtgtgtccgattacacgcagaacgcactcgcggaccttcgcggcatcatcacccaactgcgcggcgacggcgacttcaaaaagaatggcgacgagccggagaatgtggtggcgctgttgcggcgggaggccgccgcaggtgacaggctgctgcatgaccatggattctccggcgagaccgtgttggaatcggcacaggatgcaaacatgcattcgtcggaactttgcggcctgttgagcctcatctgtcatgagctctatacgaacatgctcaagcatgccgagaccgcacgcccataccacgtctcgatctcgctgtcttcatcgcacgtatgcatccgctacgccaatggtatcggcgagcagtcggtggccggcggtggcaacggtttgcgctcgctgcaatcgctcatcacctcgatgggcggcgacttctcgcatgatgccgacgatggtggatggagcggcaccgtcgagatcccgttgcagtaagggagggaagtttgagagtcacccgaatggcttccaagcctccaatctggtctgcagcagcggggatttgtccgatgcaaggcaggtgagcatggcgctgtcattcaaatcgaagctgaaccaatcgtcaggcacgctacctgccttggtgccgttcatatacgcctcgaattgcagccaatacttgttgatcgtgtaatccttgggcatcagattcccgcggtggaggcaatcgatcagcgccacctccggatctccgtagaattcgggattgcccagctgggtttgatgccccaggtctatggcagaaacatgcagatccttgcattcgtctatgtcctcgtccaatttccggctctgcgcgtcagacaggccttcggaggaaacgcagatgggtgcgaaatatactccgttgctctggttctgcggcggcttggtgtaccccgctccattaggcattgcctataggattcccacgccgtgctgtatgccgcatacgggatcttcccatcatgttgcaacgcggtgcgcagcactttcttctgagattcgccatactgtctattgttcaacattgagtcgataaaatctgttgtactacttgcgaacttgcccgtgtcggcccccgccatgctgtcgtcggtcttggagacattccccgagcaggctgatatgctcaggacacatgcgatgacggcgatcaaagatggtatgctgcgtgttctcttcattcatgcccctttgcagaacggaaagccaaacacgatgcatcaactatggccgatgttcggcttcccaaggtggtaaagatgtctatcgcaacgctttgatacgtgtcagaacaagcaaatgcccatcctaagtctctccaccatgaagcacccgatatgcgtgccacaatctgcgtgttttgttgagaaacgccgtggcgcgtcttaggaggatagtggtgcgccgcattcgaaaccacatcaacaaaacgtgtagacaggttgcgaaacggagacaaaccatgtaaggctgaaatcaggccatatcgacgaggatgtgaggaaacatgaagcagaaggggacaaggccacgccgcgaacagacccgcggtcgcagtaccgcagtggtatgggtgctgctcgccgccatcaccgcggccgcgctcacgacagggggcatgcgcgctctggctgcccgatcgggctcccacgatgctcggtatgcctcataccgtcgaatcggcgcctgcaagctcgcaggagtattccggcacgcaacaggtgaatgtggtgcccaccatcgcggccgaccggcagctgcccggtaatgccaccggaaccgtgaccgagaactggatggccggcgagctgcgctccgggtctcgcgcctatcaggtgaacgaccgcacggtagtcgctctgcacaccgcaacaccgctctaccgcgacctcaaggtgggcgaccgcggcgaggatgtgcgctcgctcaacgacgaactgtcacggctcggatacgacagcgtgccgcaatccggtgaatacaaccggaacaccggcaatggctggcgccagctcatggtggacgccggaaattcggatggcgctggcgaagacgacatgaacctgcggctgtcggacacgatgtggattcccccggattcggtgaaggtgcaggggtggagcgccactcggggcagcgcggtgcaggcgggagcgccgttgggcaccgtgccgggagggctagtgagactggcgatccgcggtggcaaaccttccgatgaagggcgcccgctcacggtattcggcgtggctgccccgttggcgcccggtaccaccgacatcacggacggcgaactgctgcagcggattgcagccaccgaaggttaccaaggcaagagcgctgaggaacgcgccgccggcatggacccagctcacgctcaacaaggcgatccagaccctacgcgtgccggtcggttcggtgttcggcatcaatgggacctcggcatgcatcgccaccggcacgttcgacaatccccatgtcgtaccggtgcgcatcatcaccagtgaactcggtgcgtcgctggtgcagccgtcgagtggtggaggagagggcgtcgatcgcgtgctgattggaccgcgcctgggtaccctgcgctgctcgtgaacgtggggaggtgaatgtgatgagactggtggtgcatgatctgggtcatagatttccaggcaccgatctattgttcgagcatcttgatttcagtgtggaaccgggaacgacagccgcaatctgcgggccgtccggttgtgggaagtccacgttgctgtcgattctggcgggctgggagaaaccatatgcaggcagcgtggaacgcgagggcatcgcaagaaccggctgggtgttccagaacccggtgggtgtggcgcaacgcaccgcgctcgatcacgtggtgttcccgctgctcgccaaagggcatggaccggcggcagacacaaccgcaggcattggaagccatgaggttgttcgatttggattatgcggcagaccgtcggttcagcgaattgtcgggcggcgaggcacagcgtctcatgctggcgcgggccgtatgctcgagacccgacatgctgctcgtggacgagcccacagctcagctcgacacgaggaccgcgcattcggtgagccatgtgcttggcaacctcgcgaaccagggcatgatcgtgctggtggcgacgcatgaccccgacacgagggacgcctgcgcgcgtaatagatctggcttgctatgcgcccgcggaggacgagggagagtcggcatggggctcaggtcaatattctcggaggcgatacgcaacatcggcagcggtacggcgcatgccctcgcgctgttcctcgtagtgctgctgggcggggtgctgctgggcggctatgaggcctacactgtggtggccatggagtgtgagtcgctgacgcgggtgcgtgccgtggccgatgtggattcggtgatcggcggaactgtcgacggcagcgcctgcgaccgattgacgcgaaccaccgacggtgcaattacgcaggctggcgccatgcgtgccggcggcgagatcactgcattgtcgacaccgaacaacgcattgcaatcgtatgaggtcacgccaggcatgttgtcgctggtcgcctcgaatggaaccaccactgactcaatcgacatgtcgggcatatgggtgcccacggaagtggcgcgcgattttggattgacaatcggttcgacgctgagtacgagccatggcgaggcgatggttgctgggatctattcatggcccaatgatgggcgtgatacacggtttgcctatacgttcttggtgccccgtgcggcatctcagggtacgtacaacgaatgctgggtgaggcaatggcctcggtctggggcggcgagcaacctgctgtattccacgctgggggtaggcgaggggtcggggcaggctggcgtgacctccctcgacaagggatttgactcgcattacgacccatatgccacgtatatggggcgtgtgacacattggattccctacctgtccatactcatcggcgtggtcatcggtgtgcttgcggtgcgtgtacggcgactggaatacgccgccgcgctgcattcggggagtcgaagccggcgctgctgctcggcatctgcacggaggtgctcgtctgggccggattgggagcattgagcgcatgcgcgttgatttgtgcgtattgtgcgcgcatggccattggtgacgttgcgtcggtgatgctcgcctcctgccgggcgccattggccatgtgctccggaacgttcgtcggcgccatcgccatggagatgacggcgcgccaatcgcaattgttcctcttgttcaagcgacgctgaatgagatgacggtagtcgcatcgcacccaggctgtgcgcccacattgtgagggaacgtgcggcgtcggtcagcggtgtgcattagactcggcatcgacacgggagctggtgcaaagcaccggctgagagagggtaacctcgaccgattgaacgtgaatccgggcaatgccggcgcacggacgtcgctctacacccgtgcctgtattcaaatagggaattgagaaaggcacacatcatgtcagcttctgtcatcgaagcgaaaccggtcctcaaatggcgtgtggtcgatatcgctgtcgcctcggtcatcggcgtggcttccgcgctcatctattggttcgtggcattcgccacagcggcaccgtggtcgctgctcgaaggcgtggtgcccgggctcgccggtattttcaacggtctgtggctgttcgccggaccgctcgccgcaatcatcgtgcgcaagccgggcgccgcgctctatgcggagatcgtcgccggcgtgctcgaggcactcatgggcaacatgtggggaggtgtcgaaaccttcctcatcgcattggttcagggtctgttcgctgagattgcgttcgccgtcttcgcctacaaaaaatggaacctcggcgtcaccgtgctctccggcgcgttgagcggcgtgggttgctgggggtattcgttcttcacccacctgcaggccatcgatctgggcggctcctacggcgtcgtgtatttgatcaccaccgtgctttccggcgcgctcgtcgccggcgtggccatgtggtacctgtatcttggcatcgccagaaccggagcgctcgaccagttcgcatcgggccgtgccgtgcgcggcgccaagcattgagctcagcaccacaactctgaggaataccggaaagcacgttatgaccactgtgaaatccgcctgcgtggaacccacgacgggcatcgccctgcaattcgaccattggggctaccgtcatgcctcgcgcaagcatttcgcggtgcgcggcctggatctcaagattcatgccggtgagcatgtgctgctccttggagcttccggcataggcaaatccaccattctcgagggggctgccggtctgctcggtgacgagaccgggcagaccgacgcatcccgagtgaacaatgcggcggagggagagcctccggttgcagtggaggacgccgacggcggcatcaccgagggggccatccgagttggtggcatcgaggtgcatgccgcgcgcggcaaggtcgggctggtgctgcaggatccggatgcacaggcgatcttccaacgactgggggataacgtggtgttcgggccggagaatctcaacgtgccgcgtgatctcgcatggcaacgtgtagatgaggccctcaatgccgttggtctggccggtgtacagctcgaccgttcggtcatgcacctgtcgggcggccaaatgcaaaggctcgccctcgccggtgcactcgccatgcgcccggaggtgctgctgctcgacgaaccaacagccaatctcgatcccgatggcgtggtgcaggtggtcggcgcggtggatgacgtgctccggcagacgcatgcgacgatggtgcttgtggagcaccgcgccgaccggtggatcgacatgatcgaccgtgtggtggtgctcggtctcgagcgcaccgacgacacccggcaggtcggcaacagcggcgaggagagcgagatcgcccgcacgaacttccgaaacaccgtggtcgtggcggatggcacacctgacgaggtgttccacaacaccgacatcgacttcaacgaactcggaatctgggtgccggagcggtatcgtacagcagaggacgagatcacgcgcatccacacggtggatgagcccgaatatgctccacagacaggtctgcccgaagtgctgctctccacgaaggagctcggcatcggacgtgacggcaacgccatcgccgaacacattaacctggacttccacccaggtcagatcaccgcactcgtgggggcgaatggggcagggaaatccacgttgtcgctcacgctggcgggattgctcaaaccggtggagggtgaggtcatcgcccatgacgggctcgcaggcgaactcgacaaggtgtggcccatcgactggacgtcacgtcagcttgcctcgcgcatatcctacgtgttccagaaccccgagcaccaattcgcctgttcgagcgtgctcgacgaggtcatgctcggcccactgcgcacgggaatggctgaggagcaggcgcgcgcacggggcatggacctgctcaggagattccatctcgaccaatacgcgcacgtcaacccgtacacgttgtccggtggcgagaaacgcagactcaccgtcgcctccgcactcgcctccgcaccgaaggtgctgctgttcgacgaaccgaccttcggacaggacagacgtacctggatgcagattgtgcggctgatccacgatttgcgttccgacggcgtgagcatcgtcgtcgtcacccacgaccgtgagctcgtcaccgcattgggcgcacgggtggtggagctcgtgccgacccgcaatccgcagggccttggcgacgacgttgctgcgaccatcgccgctcgtctggcatcgccccaggatgcggtggataccacacttgtgccggtcagccaagtgaacgagcgtgtggaggaggccaaaccggcgagccgttcgcggttccttgcctcaatcaatcccgtataccgcctgtttggagcattcctcgcctcgctgccgttgctggccagtctggactgggtttcggcaagcgtggcgctcggcttggagttcgtggtgctcatggccatcggcttcacgccgtggcgcatcgtgcgttccacctggcccatcttcatcggtgcgcccggctcggcccttgccgtgctgctgtatggcaagtccggcggcgacacctggtggcaatgggggtgggtgaacatcaccgaccgatccgccgagcttgcgttggccactgcgctgcgcattctcgcgataggtattccggccatcatcgcggtgctcggcatcgatgcgaccgatctggcggatggcttcagccagatcctgcatctgccggaccgtttcgtatatggcggtttggcgggcatgagactgttctcggtgctgcaggacgactggaccgcgctcaccgcctcccgccgttcgcgaggtctcggcgacgacagtgcggtggcatcgttcttcccgcaatccttcgcattgcttgtgctctcgattcgccgttccaccaccctggcggttgcgatgcaggcgcgcgggttcggcggcaccgcaccacgaagccatgcgcgcatgagccatgtgcatgcccgcgactattggttccttgccggatgcctgctcatcccagtcattgcattagcaagtgcggcattcgccggcaccttcagcttcatggggaattgacgcactgctattctcgcgattccgcagggagtaggcaaagaccgcgcggcgcatgtcgtgcggtcttcgcatatttcagatctcaatcacgcttgctcaattggaatacgcggtcggatcgttcggcaatctggggtgaatgcgtcacgatgatcacgcatttgttctgctcatgcgcgagttcaataaagatgcgcatgatgtcgtcctgcgtggcagggtcgagattgccggtcggctcgtcggcgatcaccacttgcgggttcgtgctcaatgcgcgggcaattgccacgcgctgctgttcgccacccgacagatgcaggatgcgctcgtttgcataccgttcgggcaaatgcacctgcttgagcagatcgagtgcaatgtcgcgcttcggcctgtcgaatctcttgccgctcgcgtccatcgtgagcatgatattctcaagcacggtgaggccgggcagcagattgaaactctggaagatcacgccgatgtcgcggctgcggtagcagtaccggtccatcttcgccagattgtgcccctcgaacagcacctcgccgccggtgggtgtggtcaatccgctgatgagcgacagcagcgtggttttgccggcgcctgacgggccgacgatcgcagtcaccgacccgctggggaaggtgtaattgatgtcggagagcacattgcgtcctcctttggcgtaggcatagctcacatccttgagctgcagaatcggcacggacgtctcgccgtccgccatggcgctatgtgtggtgggtgtttcggtttcggtatgcatggtcatcgatgttccattctgttaggtgtgtggggattcccgttcatgaacggtctgcgagaatctgcagtggctcgtagcgcatcacgaatatcgccgcggtgagggaagcgagaagcgtgagcgccgatccgatgagcaacatccatccgatggtcgcccagctcaccgtcgcattcacctgtttaatcgcattcgatgcgtgctgcaggccttgcggcatgccgctttgaggctgcttcccctcgttcggtaccgcggattcgccctgggtattgtcggtattcggtttcgcggactgagcgttgccgtccggtgctgcgccgggggcaccttgcatatcgcgtccgaactgtgctcgccgggattcctgctgtgattgttgcgaagccacctgcgaggagagcagcgcatccgataccggcacggaggtcgccgcccctattccggttccgacgatgagtccgatgagtacaacggtgagcagctcgactgcgaactgtgcggccaccttccacttcttcacgccgatggcggtgagcacgccgatctcgtatttgcgctcgcgaatgttgaagatcgtgaggatcaccagtacaaccgcacccactgaaagcacgacgatgagcatcgtccttgcgaatttggaaagattgtcgatgggcacgagtgactgcccgtactgttcgacgtccatcgatgagacggtgtagtcgtccgagagtcccgctttcctcacatcctcggtgaatctgtcgtagtccgccttgccgtcgaagacgtatgtgaagctcaactgtgcggcggaggtctcacgcgtattgcccttcgaatcggtgatgctcagggttttcgtgctgtcgagaccgatcttgccgagtgtggcggcggacatatagattgcgttggcggcgtcattcgcgctcgacgccatggggccgcccatcggcatgttcgattcctgcgtgttcgaatagatgcccgccacggtgaacgtgtaggtcttcttcgaatcggagatgttggcgagtttgaacgtgctgccaaccttgagattgttcgcgtcggcaagcgtcttcgagacgagcacaggatttccgtcggaagcatcataatcgaacgctttgccggagttcatggtgaacgagccgttcggtgcgttcaccagtgcctcgtcgctggagaagcccaccaacgagaagtcgcctgtggtcatggccgggccgccgttctgaccgcccatgtcccgcggcatgtcattcggcatggcgccctcggttccggctcctgcggtcccggtatcggttcttgaattggcgttgtctgaggattcctgcgaggaaccgttgttcgtgtcgaccgcttcgattcctccgtccactgcagctgcggaactcgtctcgatgtaatacgagctgctcacgccgtactcggatttcgcgtactgttcatagtcgccgagcgtgagttgcttctcctacgtggccttgccgaaactgcccatatcaggcttctgcccggaggagttcgcggattgcatgatcttgtttcggtccagcgagatctgcgcgccgatcgtcgtgttctccaacgcagaggcacgggcgcgttgtgccgcctgaacaatggcgaagccgatcgtcgaagcggcggcgatgatcgtcgccacgatgatgatcagcacactgcgtcctttgttgcgccatagattccgtatggcgttgtgcacaatgaacatgactctccttatgcaaaacacaaatatcggaatggtgtgcatttgcccatagcgtatccggtgcgggttgtgaggagcggcaaacgcgctggcatcttcccgtatgtttactgggagctttctgaaaatgggcaccgcgcgctacgctggcggtatgcccatagatcagcaggtactcacgaacaccaaggcggaacgtatccgtcgcatatccgaactcaccaaccgaaagcaccgtcagaaggcggggaagttcctcatcgaagggccgcagtgcgttcgcgaggcgctcacatggcagccacagatcattcaagatgtctatgtgcgcaccgatggggcggatccggattccccgatcgcctcgaccgcgttgggcaagcttgccggtgaggcgatggaggagcggatccatgtgcacaagatgacgcaggaggtggagcacagggtttcccatgatgcccagggggtgtttgcggttgccgacctgaattcctgccgtgacctgcttggacgggttccgcagactccccatccgttccttgccgcattctggcagatgcgcgaccccggcaatgcaggcaccgtgatccgcagtgccgacgccgctggttgtgacgccgtcgttctggtgggcgattgcgtggacatattcaatccgaaagtgattcgtgccaccaccggctcgttgttccatctgccggtgcttgctatggatgagcgggcgttcttcgacctgtgcagggagcgcgataccaccgtgctggccgcagacgtgtacggcaccgagggcaagcctccggtgagtctgccggatctgctgcgcaacagagagttggtcgaggggtccaaggccgtgttgttcggcaatgaggcccgtggcctcaccacggaactgcttgacgaatgcgcgatgagcgtctccattccgatctacgggaaagccgaatcgctcaatctgggaaccagtgcggcggtgatgctcaccacgttggccatgtcgagtcgtattgaaacaatgggaagtcggtaaaccgttggaatgatgcgactttctctattgtcgcaacagggttttgcatatgtgtgcacgatgtaggaaagggttcttgtggcagaaggcatagtattcgacgccgatgcggtgtccaaagacatcgccgaaggcatcgccgcgatacaacaggcctccacgatggaggaactgaaagccatcaaagcgaagtacgcgggtgcaaattccgcgatgacgagggccagcaaggcgatcggctcgttggcgaagaacgagaagaaggaagccggcaaggtcatgggcaagctgcgtgccgatttcggccgtgcctatggcacgaaggaggccagcgtgaaggcggcccaggaggctgccgagctggccgctgaaaccgtcgacatgacgttgccgattcgccgcaagccgcttggtgcccgccatccgctgcccaagctcatggaggacgtcgaggacttcttcgtgggcatgggatggcagatttcggacggccctgaggtggagaccgaatggttcgacttcgatgcgctgaacttcggtccggaccatccggcgcgccagatgcaggacaccttctatgtgaagggcaaccagtccaaggatgccgccggttttgtcggctccaacatggtgctgcgcacgcagacgtcgtcggatcaggtgcgcgggctgatctcccatggcgtgccgctgtacatcgcatgcccgggacgagtgttccgcacggatgaactcgatgccacgcacaccccggtgttccatcaggtcgaggcgctggcggtggacaagaacctcaccatggcagatctcaagggcgtgctcgacaagctcgccgtcgcgatgttcggtccggaggccaagagccgcctgcgcccgagctacttcccattcaccgagccgagcgccgaactcgatctgtggttccccgacaagaagggcggccccgggtggatcgaatggggcggctgcggcatggtcaacccgaatgtgctgcgttcagccggcatcgacccggacatatataccggattcgctttcggtgtgggcgtggagcgcacgttgctgctgcgccatgacatcaacgatatgcacgatctcgtcgagggtgatgtgcgtttcagtgaacagttcgtgatgggggagtgagaatatgccaatggtagatatgggctggctgcgtgagcatgtggccgtgccggagaacgagacctatgaggaactcgcccgtgacctggtgcgggtcggccttgaggaggaggagatccacaccagcaacgtgacgggtcccatcgtcgtcggctatgtggtggacgccacccctgaaccgcagaagaacggcaaggtcatcaactggtgccatgtggatgtcggggaggaatacaacgacgtcgacgagcatggcaataaggtgccacgtggcatcatctgcggcgcgccgaacatgaaggccggcgagaaggtcgtcgtcacactgcctggcgcagtgctgccaggtaatttcaagattgagccacgcaagacctatgggcatatctccgacggcatgtgcgcttcggaacgtgagcttggtttgggcgacagccatgacggcatcatactgctgcgcgattatggcttcacgcctgaggaatacgaggcgttgcaacctggcgacgatgccatgcacctgctgcatctcgacgagccgattcttgagatcaatgtgacccccgaccgcggctatgccttctcgtatcgcggcatcgcacgcgagttccacaactccaccggggcggagttcaccgatccggtggccgcctttgaagagcgtgcgccacaacttgaggaccagaacggtcagacgcacgacatcgatgtgatcatcgatgacgacaatccgatccatggtgtggtcggatgcgaccgtttctatgttcgtgcggttcatgactacaagccgggcagcccgacgccgaattggatgcgtcaccgtctgtcgcgagcggggatgcgttcgttgagcctgccggtcgatgtgacgaactacgtcatgctcgatctggggcagcccatgcatgcgtacgacctcgacaagatcagcgggccgatcgtcgtgcgtcgcgccaaggctggtgagacgctggtcacattggatggcaagaagcatgacctagatcccgaggatctgctcatcaccgattccccgaatggtgagcagggatcgcgcattctcggcatcgccggtgtcatgggtggagaatatggcgaggtgacggacgagaccacgaacattctgcttgaggcagcgcatttcgacccgatcaccgtggcacgctctgcacgccgccataagattccctcagaagcctcccgccgctttgaacgcggggtggacacccagatccaacccgctgcggctcagatggccgtcgacttgctcaccaaatacggtgacgcgaaggccagcgacaccccgcgagacgtgaacaacgtcaagcgtggccatccgatcgccttcaaggccggagaggtgaagcgactgacctcgctcgatcttgacatcaacaagatcagcgatatcctcaccgatatcggatgcagtgtcgccggaggtggcaatggcgaattctcggtgacggcccccagttggcgccccgatctcaccgcagcctgcgatctggtggaggaagtggcccgtatctatgggtacgaccgtattcctgtacgagtcccgcatgccccggtggaaggccatgtcggactcaccgacgatcagctgcacaagcgtcaggtggccgacgagcttgccgaatatggtctggtggaagtgctcagctatccgttcgtgggcaaagcggacttcaagaacttccagatcgactcggaagaggtcgaaaaggtgagcgtcgagatagtcaatcccctcgcaggcgatcgcccgttcctgcgtcggcaggttctgctcacgctggcgactacggtgcaacgaaacctgcaccgcggtctcgagaacatctgttgctatgaacttgggcatgtatatctggcagatcctgaagctcctgccgttccggctctccccggcgcacagcgccccagcgacgatcagctctcggctcttgatgcagggttgcccgagcagccgctgcacgttgcggccattctcaccggcaatgccgaggacgatggatggttgggcgacaagcgtcctgtggattggacggatgccgtcgaggctgtgcatcgcatcgccgatcgtttgggtgcgaagatcgtgctcgaccagtcggacggtgacaaggcaggtgcccaatggcatccgggtcgcgtcgcgcgcatcatgtccggcgacaccccggtcggtgttgtaggtgagcttcacccgaaggtggacgatgcactcggtttcccacgccatagcgccgcattcgaaatcgatctgaccgctctgttctccactctgagcaacaagccggttcaggcgaagccgatctccaccttcccgccggtcaagcaggatttggcgttcacggtgccgacctcggtcacggcgcacgaactcaccgagacgattcgtcaggcggcgggcgatgtgctggaatccatcgagctcttcgatgtgtacacgggcgatcaggtgggggacggcaagaagtcactggcctatgccgtcacattccgtgcaccggatcgcacgctcacgtcgcaagacagtgaggaaatccgacagcgtattgttgagaagacggctacacttggtgcgcagttgcgtgcttagcgtcggcaggcatcccagcatatgaaatgaggtagggaaatgagcgaacaagagcagcatgacacctccaacggtgttccgaacgagccgaacgaccagcatcatgctgctccgaccgcccacggcgaacgccatgcaatcaatccggatgccgcacaggacgatgtgagggggctggtgctcgatgggcgtttcgacgacgacccgccgagcgtcggttcctccaatggcctggagtacggcgctttggacagccagttccctgccacctatgatccgtatatctacgggcatccggacactgacgatgctttgggggcagccgctgcgcgagcccaggcccagcgggggaacgagtatggccagccgtcccaacagaatgcctacggacagcaggccggactgccgtaccagacccagaaccagcccggttccggacgtcagggcaatggaggacgaaaccagccgccattcaatctgaacgacccaagcttcatcaacagcatgaaccagatgaacccggacgaccccaatcagaatccgctgtatgggcactgggatccgggcgccatcatcgcgttcgtgttcgcgctgattctcccgttaccggtgctgccggcgctcttcggatggttcagcatgcgtcgcacgaaaatctaccatatgaaaggctatggattggctgtggcggcgctggtgatcaacgtgctctatacgatcatgtggctgtacttccttgtctcaggtgtctcaccaactgaatatctcaaccaaatgttgaatactttgaataatggttccggtggatctgattccgtaaaagcctagtattccagtggttaaatcaactttgcccatattctgacttcattcagacatgcatgtttatgcaatgtactgtatatttgttaggatatgggcaaagttgtaatgacgtcggcatgggagaagagcatatgacgaaatacacggttgccgtggcaggggctacgggctatgccggaggggaggcgttgcggatcctggccgcccatccggccttcgaggtcacggcggtggctggccattcgtccatagggcatcgactgggggaataccagccacatattccgcaactcgcggatctcattgtggaggacactacgccagccgtgctcgacggccatgacgtgatcgtcctcgcgctgcctcacggagcctcaggagccttggcggcgcagcttgacgatgacgcggtggtggtcgatctgggtgcggaccatagacttgagcggcagcaggcgtgggacgactattatgggggagatttctaccagcattggacctatggcatgcctgagctcattcttggaatcggttccgacggcaagtatgttcgccagcgcgacgaactcaccggagccaagcgcatcgccggtccagggtgcaacgtgacggctaccacgctggcattgcagcctgcgattgcccaagggctcgtcgatacgaagagcattgtcgccgatctggccgtggggtattccggcgcgggcaagaacctcaagcgcaccaatctgctcgcttcggaggccatggggtcggcgtcgccgtattcggtgggcggaacacaccggcatattccggagatactgcagaatttcgcccatgcagccggacttggtgcgtcacaggccgatatgttctcgcttgcgttcacccccattctcgtgccgatgtcacgtggaatcctggcctcggtgagcgcaaagctcaccgatgaggccctcgcgctcaccgatgaacagatccatgacatctgggtgcaggcctatgaaggtcaggaattcatcttcgtgctggatcccggcgtcatgccggccacccagaacgtactcgggtcgaacgcggcccatgtgcaggtcgctgtcgatcgacgatccggcacactgcatgccttcaccgccatcgacaacctcaaccgggggacggcggggcaggccattgaatcgttgaacatcgcattcggactgaatgatgcaacaggattgagcaagattggagtggcaccgtgagcgttacattcgcaaagggattcgaggcggctggtgtggttgccggcatctcctcgcagacaggcaagcaggacgtcgcattggtggtcaacaacgggccgctcaatgccgcggcaggcgtattcacctcgaaccgtttctgtgcggcacccgtgcagtggtcccgcaagcaggtttcagacggagagctcaaggcggtcattctcaattccggaggcgccaacgcctgcacgggagaggaagggtaccagcagacggtgcgcaccgcggaagccgtcgcgttgatgatgcatgtggagccgtcggagatagccgtgtgttccactggccttatcggtgaactgctgcctctcgacaaagtgatcgaaggcgcgcagaaggcctttgactcattggattccagcgcccaggcaggcagtgatgcggctcatgcgatcatgaccaccgacacgaagcctaaaacggtgaatcgtctggggtcgaatgaattccgcatcggcggcatggtgaagggatccggcatgatcgccccgcagctggccacaatgctatgcgtgatcaccaccgatgccgtcgtctcggcaggtcagctgcaggccgccctcaccgccgccgtcgatcgtagtttcaaccgcatcgatgtggacggttgcatgtcgaccaacgacaccgtgctgctgctggcatcgggtgcctcgggaatcactccggaccccgacgaattcaacggcttggtggccgattgttgctccagtctcgcgaggcagatcatcggtgacggagagggcgccagccatgacattcgaatccgggtcaccggtgcgaccagtgaggatgccgcattggcgtgcgggcgagcggttgccgcatcgaacctgctcaagtgcgccatcagcggcaatgacccgaactggggtcgtgtggtcagttccctcggcaccgttcccgccgatgtggccccgtacgatccgaacgaggtctcagtcaccatcaatggcgtgagaatctgcgccaatggcggtccggaccgggaccggagcgaggtggacatgacgctgcgcgagatcgacatagacatcgacctgaacgccggggagagcgaagcttgcgtgtggaccgacgaccttacccacgaatatgtacatatcaacgcggattacgaaagctgagtgtgactcatggcaagcccgttgcgcggacccgggtatcatctcgatgtgcataccgatctggggcccgatcagaaagcggaggtactcattgaggcactcccatggctggaggagttcttcggcaagaccattgtgatcaagtacggcggcaatgccatggtgaacgaccacttgaaggagtgcttcgccgaagacatggtgttcctgcgtcaggtgggcatccaccccgtggtcgtgcacggtggaggcccccagatctcccagatgctcaaggcgttgggcattcattcggaattcaagggcggcctgcgcgtgaccactccggaggcgatggatgtggttcgcatggtgctcaccggcaaggtgtcacgcgagctcgtcgggctcatcaatgcccacggacctttggcggtgggtctttcgggtgaggatgcggccctgttctcggccagccagcgcaagccgatcatcgacggcgaacccaccgacatcggtttggtgggcgatgtggtgggggtcgatgcctccgccgtcgtcgacctcatccatgccggtcgcatccccgtcgtttcctccgtggcccccaacgaggacgatgccaccgaggtgctgaatgtgaacgccgattcagcggcagccgcgctggcctcggctctgggtgcccataagctcgtgatcctcaccgatgtggacggcctgtatgccgactggcccgacaagaactcgctggtcggacgtatcggcgtcgaggacctacgggatctgctgccggaattagaatccggcatgcgtcccaagatggaggcctgtgtacgggccatcgatggaggcgtgcagcaggcccatatcatcgacggccgtaagccgcactccattctcaatgagattttcaccaccgccggtgtgggcaccatggtggagcccggcgagggcatggaattaaggagctcctatgacctctgaacaaattgatctgacgcatgacaccgaactgatcggcgaatacgagcaagtgcatatgcatgtgttcggcacgccgcttcgagtgctcgatcatggccagggcacccatgtttgggacgtcgatggcaacgagtaccttgatttccttgccggaatagccgtcaactccattgggtacgcacaccccgcgtggatcgaggccgtgtccgctcaggccgcccaggtcgcccatgtgagcaactatttcgccacgagaccacaaatctccttggctgccaagcttgtcgaactcgccggtgcgccacagggctcccatgtgtatttcggcaattcgggggcggaggcgaatgaagcggcgttgaagctcgccaagctctatggccgcagtctgggtgccgataagccgtaccgtattatcgccctggaacacggattccatgggcgcaccatgggcgcgctttcggcgacctggaagccggcgattcgagaaccgttccaaccgttggtgccaaatttcgaattcgtgccggccaatgatctcgatgcgatgcgtgctgcgttcgaggcgacagattcgggtccggtggcgtccgtgatcatggagctcattcaaggcgaggccggcgtgctgccgctggatcctgaattcgtacgcggtgtgaggagtctgtgcgatgaacatcacgccaagcttatcgtggatgaagtccagaccggcatggggcgcaccggcaagtggttcgccttccaacgcgacgatctcggaggcattacgccggacatggtcacgttcgcgaaaggtgtggccggcggattcccgatgggaggcatgattgcctttggcgaggagctcagcaacctgttctcgccaggcacccacggttccaccttcgcgggcaatccgttgggggcagctgccggactggcgacgatcggtgtaatcgaacgtgaggatttgctcgtcaacgccgaggcgcgcggggaacagttgcggcggcagattcgcgcatgcggcaatccgctgttcgaatccgtgcgtggccgtgggctgctcaacgcgatcgtgctcacacatccctgcgcgcatgcggcaatggattgggcactggagcacgggctcatcatcaatgccgtggcacctaacgccctacgtctcgcaccgccgctcgtggtgagcgagaacgatgttgacgaggcggtccacgtactggctgcgatcccctccgacctgcccaatgactgaaatacgctagcgacccacgccagtgggcgcatacgattatctgagcatcggtaaccaatctctatagcaaaggaagtgttgcaatgggcgaactgcgtcatatgctgcgcgacgacgacgtgaaccatgaggagcagaagcagattctcgaactcggcatgaaattccgtgccgatcggttctaccatcgacccttcgagggccctcagggtgtggcggtgatcttcgacaagccaagcacccgtacgcgttccagcttctccatcggcgtggctgagttgggtggttaccccctggtcatcgacaagtccggttcgcaacttggccgcggagagccggttgccgacaccgccgaagtgctgacacgcatggcctacggcatcgtgtggcgcacgttcgagcagtcccgtgtcgaacagatggcacgtgtcgccactgtgccggtggtgaatgcgctgaccgacgagttccatccctgccaggtgctcgcggatttcctcacgctggcgcagttcaagggcggcgtggacaatctggagaatctgaagatcgcctatgtgggcgatgccgcgaataacatgtcgaattcatacctgcttgcgggcgcggtcgccggcatggatgtgcgtgtcgcagggccgaacggctacctgccggaccagaagatcgtcgaggatgcccaggccatcgccgagaccacgggtggcagcatcatggtgaccgtggatccagagcaggcggtcgacggtgtggattgcatcttcaccgatacctgggtctcgatgggagaggaagccgaatacgcgattcgctcgaagccgttctggccatatcaggtgaacgaacgtctcatgggtctggccaagccggatgcgctcttccagcactgcctgcctgcatatcgcggcaaggaggtcaccactggtgtcatcgacggaccgcagtcggtggtctgggatgaggcggaaaaccgtctgcatgcgcagaaagcactgctgacatggctcatcggcaagcagcgtggtgatgagagtctgctgagctgaaagattaaggagtacgcagttgagtgaacagaccggatcggagtcaagcaacggcgcaagtggtgtcggccgaccgagcacgcgtgcagcgcgtctgcagatggtgcgtcagcttttggccgacaatgtggtgacgtcacaggcgcagttgtcggaactgcttgcacgggagggcttccccgtcacacaggcgacaatgagccgtgatctcgatgaggtgaacgccgccaagaccagactcgccgacggtaccattgcctacgctgtggccgatcaggtccccctggccaccgtgcctgaatcgaatggtcagggacggggtgagcaacagcttgccaagattctcaccggtcttgtcgtctccgtggcccacgcctcgaatttcgtgatcgtgcacacgccggccggcgcagcacagtatgtggccagcggcatcgacaagcattcgattgacggggtgctgggaacgatcgccggcgacgatacgatactcatcatctgttcggatgacaccacagctggtcgccgagccgaatggatgctcagaatctcatctcgatcgtgagattgcgtgtcgaaaatgaataaatatacagtagaccgtatatagttgtaatatcaactgcaatcgtgaaaggctgaatatgagcgacaagaaccgtattgtgctggcatattcgggaggtctcgacacctccgtggcaatcccatacctcaaagaccgcacaggcaaagatgtagtggcagtgtctctggacgtcggacagggtggtgagagtcttgagacgatcaaggagcgcgctctggcatgcggtgccgtcgaggcatatattgtcgatgcccgcgacgaattcgccaatgaatactgcatgcaggccctgaaggccaatgccatgtatgagggcgtctatccgctggtctccgccatctcccgcccgttgatcaccaagcatctggttcgtgcggcgcaccagttcggtgcagacacgatcgcccatggctgcacgggcaagggcaacgatcaggttcgtttcgaggtgtcgattcagtccatagacccggagctcaaggccatcagcccgattcgcgatctttcgctcacccgtgatgtcgagatcgcctatgcgaatgagcatgacctgccgattgtgcagaccgagaagagcccgttctcgattgaccagaatgtgtggggtcgcgccatcgagaccggtttccttgaggacccgtggaatgcgcccaccaaggattgctattcctacaccgatgatccggacttcccgcctgtcgaagacgaagtggtcatcgaattcaaggaaggtgtgccggtcaagatcgatggtcgcgaggtgacgccgttgcaggccatcgaggagatgaaccgccgcgccggtgctcagggcatcggccgtgtcgatctgatcgaggatcgcctggtgggcatcaagtcccgtgagctctacgaggcacctggtgccatcgccctcatcacggcccacgaggaactcgagaacatgtgtctcgaacgtgagcagcatcgcatcaagcgcggcatcgataagcgctgggccgaactggtctatgatgcgcaatggttctccccggccgtgcattcgctcaacgcgttcatcaatgacacccagcggtatgtgtccggtgagattcgcatggtcatgcacggcggccgtgccgtggtggtgggacgccgttccgacagctcgttgtatgactacaacctcgccacctacgattccggtgacaccttcgaccagaatgcctcgaacggtttcatcgagatctacggactgccgacgaaggtcgctgcagcccgggatgttcgcttcggcaacggcatcgaagttccgcagaacgacgtagagtagtctcacggcgcagttcccatggaatgcttatgcggggaagaggcgtgaaaacgcctcttctttcgtattccaagccaacacggacggcatggccgtcttcgcaaaaggagagatatgagcgacgatcacaagcccgaatcccaggatcacctggctttgtggggagggcgattctcgtccggcccctcgcccgagctcgcattgctgagcaagtcgactcagttcgattggcgtctcgctgacgatgacatagccggttcccgtgcccatgcccgcgctctggggcgtgcaggcctgctcaccgcagatgagttgcagcgcatggaagccgcattggatgaactgcagcgtcaggtggattccggtgaattcacgccgattgacgacgacgaggacgaagccaccgcattggagcgcggcctgctgcagattgccggtgacgaattgggcggcaagcttcgtgccggtcgctcgcgcaacgaccagatcgccacgctcatccgcatgtggatgcgccgtcatgcccgcgtggtcgcaaaccagctgctcaaccttgccgatgcgcttattgtgcaggccaaggacgccggccatacggtgatgccgggccgcacccatatgcagcatgcccagcccgtgctgcttgcacatcagctcatagcccatgtctggccgttgctgcgtgacgtggagcgtctacgcgactgggatcagcgcgtggacgccagcccatacggttcgggagccctcgccggtaacacgttgggattggaacccgtggccgtggcccgggagctcggtttcaccaacgtgacggagaattcgatcgatggcaccgcaagtcgcgatctcgttgccgagttctcatttgtcatggccatggcaggtgtcgacatctcgcgtctgtcagaggagatcatcatctggaatacccaggagttcggtttcgtgaagcttgacgatgcctattccactggctcgtcgatcatgcctcagaagaagaatccagacatcgccgaactcgcccgaggcaaggccggccgtctcataggcgacctcactggcctgcttgccacgctcaaaggtctgcccacagcctatacgcgcgaccttcaggaagacaaggaagccgtgttcgatcaggtcgacacgctcgaagtgctgctgcccgcattcacgggcatgattcgtacgatgcgctttgatgagcagcggctggagaaggaggcccccaccggattcgcgttggccaccgacattgcggaatggttggtgaagaacggtgtgcccttccgccatgcccatgagctttccggtgcgtgcgtcaaggtggcggaaaacaggggggtggagctatgggatctttccgatgacgatttcattgagattttccgtggcttcgtcgaaccggatgtcgcggtggaggttcgggaagtgctctccaccgaaggatcggtatcggcccgagccggcaagggcggcaccgcgccgaatcgtgttcgcgagcagatcatgagcgccaagacgctcatcgagcagcttcgcagcttcttccaggtgaagagcgacggcatggcctacaaggcctgcggctcgctcaataagcaatgagtgaccgatagcatatgaagcggcgatggggtgcgggccggattgccggtcgcaccccatcgccgtatgcagtgctgaaccggctagcggtactgcatgccgccatcgacaatgacggtctgacctgtcacatagcgggcattatcactgacgaggaatgaaaccacacccgccacgtcatccggagtctcacagcgcttcaatgcgatggtgtcgaccatgtccttgaaattctgtccgagcggtttgccgttgagcttgctcatctcctcgtcgatgaacgtccacatcggtgtgtccacaatgcccggagcatacccgttgactgtgatgttgtacggggcgagctcctgcgctgcggcttgcgtgaacccgcgcaccgcgaacttcgtcgagctgtatgccgacaggatggggaagccctcgaacccggcgatcgaggatgcggagacgatgtgcccggtcttcttgccgagcttgatcatcttctttgccgccgcctgcacaccatagaccatgccgaacaggttgatgcggtaaatcgtctcaagctcctcttgcgtcacgtcgagcatcggcttgatctggcatatgccggcgttgttgatcatggcatccagcgtgccgagctcatttacggtatcgtcaaccaaaccgaatacctgatcacgctgtgatacatcggtggggcggaagaatgcccggcgtccctcctgttcgatccggtggatcgtctcctcggcctcctgccgctgaccctcgaggtcagccacggcgacgtcgaagccgtccttagcgagtttgacggcgatgccgcgtccgatgccgcgcgccgccccagtcacgattgcaaccctgatgtcagtcatagcgtcctttccgtccggaagcatgtgcagacaccgttgtctgcgaacgaacatgccgccgacctacatcgaatccgattatattggaaaagcgcatgcatcgcatatgcaactcgccgcatatgccggcacataccagggcgaaggaggcggcatgcttgatgacggcggaatccatgccatcgtaaacgcatatggtgccgatattctctcccatgagcagatgcagatcgagagggactcgttgcagcatggtgccgtgaccacctatgagcattccatcgccgtggcctgtctgagtgtgaaaatcgcagatcgcctccacctttggcatcatgtgaacctgcgttcgcttgtccgggcagcgctgctccacgattacttcctgtacgattggcatgagaaagacaacgggtcgcacaggctgcatggtttccggcatccgtatactgccgaacgcaacgcccgtgccgacttcgaactcgacgacatcgtgtccaactcgattcgcacccacatgttccccctcacacccattcctccgaaatacctcgaaggagtcatcgtcaacatcgccgacaccctgtgcgccatacgtgagaccctgtcgccctcccgtttccatgccgctaaaccctaagcaaatagagggttccaggtgtcgtgaacctatgacacactaagactgcccgtcaatcgcgggatcacaacacacgaggagaataggtatggctcacgtcatcgatttcaaggaagccggatttgattccgtgctcgatgaattggaatggcgcggcttgatctctcagtccacagatagggatcggcttgcgcacacactcaacggagagccggtccactattattgcggtttcgatccgacagcaccatcgctgcacatcggcaacctcgtccagctcatcatcatgcgccaccttcaggaagccggtcatcatccgatcgcattggtgggtggtgccacaggtctgatcggcgatccgcgtcagtccggcgaacgcatcctcaaccccaaggacatagtggaacagtggtgtgagcgtttgcgcatccagattggcggcatccttgaacaggagggctccaatcccgtcaccttcgtctcgaactacgattggaccgccacgatgaacgtattggacttcctgcgtgacatcggcaagaacttccgcgtgggaacgatgatctcgaaggacatcgtcgcccgtcgcttgaattccgaagagggcatctccttcactgaattcagctaccaggtgttgcagggcaacgactatctgtacctgtacgatcattacgactgcgtgctcgagctcggcggttccgaccagtggggcaacctgacctctggtctcgatctcattcacaaggttcgcggcgtcaatgtcaacgtgatggccagcccgatcatcaccgacgccaatggcaagaagttcggaaaatcggaaggcaatgcggtctggcttgaccccaacatgctttccgtctacaagttctaccagttctggctcaatcgtcccgatgtcgagatggccagcctgctcaaggcgttcacgttcctgccgaaggccgagatcgagcgccttgtcgaggccaccgacacgaatccgggcgcccgtgaggcgcagcgggtgcttgcctgggaagtcacgagcttggtgcatggcgatgagcccacccgcaaggccattgacgcttcggcttcgttgttcggccgcggcggcgatctcgccgacatcgatttggagactctggaaagtgtgcttgacggtctcaaagtcgagaatgaggcgggggaaaaggtgttcgcacaggcccttcccggagaccggatcgcacaggccggtgtgagtgccgggctgttcaagtccatctcggaggcgcgcaagacgatcaagtccggtggcgtgtacgtgaacaatgtgcgtgtggaagatgaggagcagttgcttggcgatggtgatttcctcaagggcaggttcgtggtgctgcgccgtggcaagaaggccctcggtgtcgtggcacgcagctgatgccgtgcctgacaccattggccgcatcgccttttgacgcatagaagaaaacaggcttgcatggcctgcatcagttagacttagacctagaacacgaaggcgggcgaaggcccgtctcttacgcagaggtgcaacatggcagacgaacgtggttcgcgcaattcgaataactcccgtgggcgttcctacggtaactcgaggggcaattccggctcccgtggccgtggcaatggcggtggtttccaccgtggcggcaattccggctcccgcttcaactcccataaccgcaatgatcgcggctaccgccatgaaggtgacggtgagttccgtcgggatggcaatggccgttacagccgcgacgaccgtcgcgattcccgtgatggcagccgtcgcggcaacggagagcgccgcggattccgccgcgatgatgaccgccgcggtaatggtggtttcaggcgccgcaacgatggcgatcgtcgttttaatcgcgacgacaaccgcggggatggtgaacatcgcggattcagtcatgataacgaccatcgttccaacgggcgtcatgatggcgagcgtcgatatgaccgcttcgaccatgccggccataacaatgaccgtcgtaacaacccgcgctataaccgcgatgatgaccgccgcggcaacgaccgtcatggcgaccgcaacaaccgcaacgaacgtcgcgagttcaaccgtgaggatcgtcaggcatatcacgatcgcaagcgcgatgagtacatgtcaaaatcgcgcaagaactccgatgggacggtgagcttcccctcgcagaacccatacgaccatctgcgcccgggagagccaaaactgccgaagggactcgaatggagcatgctcagcaaggacgagcgtgagcgactgcgcggcctgtccaaggagcatgccgaaaacatcggcttgcacatcctggctgcctataccttggagggaaacgatcccgaccgcgccctagcccatgcgaagtgggccgccaagcaggcgtcccgtgtcgacatcgcccgcgaaacgctcgccatgatcgcgtatcgtcagggtgactacaagcttgcattgcgcgaattccagacggcgttccgcatgaacggctacttggattacctgccgttcatggccgattgcgagcgtggcctcggcaagcccaagaaggccatcgagctgtgcatgggtgatgacgcgaagcatctcaccggtgaggcgaaggccgagatgttcttggtctacgctggtgccttggccgatctcaagttgtggaatcaggccattgaggtcgtgtccaagctcgtgcatgccaagggccttgcaggcgaataccgtatgcgcgccgctcaggccgagcagtacttcctcgaggaatcgggacgcagtgacgaggccgtggcgatggatgagctcattgacgatctcgaggatcgctatgccgacgtcgaacaggatgagaccgacgatgacttcgtggtggactacgacgtcgaggatcttcccgaggatctgcaggccaagctgggtgtcaccccagatgacgcccagtatgcgccgttcgacgatgaggatggtgtgaacatggacgatgagacgcgcatccccgccgaggagcagcgtgcaggggccgaaatggacattgaaccagctgaaatgcaggagcgcaatactcgtcgcgacgaggagggtctgatggcagatcccgatctgacggatgcgcaggacgacatcgacgaggaggacgccgagatcggcgattccgaggaggagatcaaggaagagacggagtgacattgttgaaggccaccgaagcaccgttgagccagacgtattccttggcactgctcgacctcgacggggtcgtgtatcgaggcaaggatccggtggcctttgcctccgaaagcattcgtcaggccgaacatctcggcatgaccattgaatacacgacgaacaattcatcgcggatgcagtctgtcgtggccgaccaattgcgtggtttcggactggacgtggagccctggcaggtcatcacctcgtcggtcgttgctgcacgcatggtgtccaagcatgtacctcagggtgccaaagtgttggtggtgggcgcggaacacctgcaggacgaggtgggcaaagccggcctgacaccagtgcaatacgccagcgatcatccgacggcggtcattcagggatggttcccgcagatgacttggcagatgctggcggaggcgtcattcgccgtcgagaacggcgccatgtatttcgtgacgaaccgagacctgacgattccacgcgaagctggcatcgcaccaggttgcgggtcaatgattcaggcagtcatcaatgccaccggcgtgcaacccatcgcctcggcgggcaaaccggaatcggccatgtatgacgaagcacgcgaacttgccgcgcaaggcgacacagaaccggtctgcaaagcaaggagcctggcaatcggggatcgtctcgacaccgacatcgaggcgggcaaccgcggtggctacgactcactggccgtgctcaccggtgtgacgaatccgaccgaactgatgtgcgctccgaagcatctgcgccccacctacattgtgcgtgatctgcgcggtctcaatgaggcatacccacgaatcgacgtggatgaagccggcactcgggcaacctgcgcgcaagcgcaggccagtctgacccatcggcgactcaccgtgaacgaccccaacgatgtcaatgcgctgcgggcggcctgcgctttgacttggcaagctgcggacagcgggcaggatgtcgctgcattcgcattgcctgaattcagtctcggcgagtgagcctgcctgcgtgtcgtggatgaatcagcatgacccatatggaatatgaacacacggggatgcgcgaagagcgtctcgacgtcgtggtcgccaatgcgacaggtgaatcgcgatccaaggcacaacgtctgatcaaaacaggcaaggtgcacgtcaacgggcatccacagacaaagccggcatacgcagtgcagccggaatcgaccatcagtgtgcacatggccatggaagacgattatgtgtcgcgtggcgcactcaagctgctgggagcattcaacgcgttcgcgccagcgggattcacctcggttgaaggcaagcattgcctggatatcggtgcctcgacgggaggattctgcgatgtgctgttgcgtaggggagccgcacaggtgatcgcgctcgacgtcggccacgggcagcttgatccacgtatcgccgacgatccacgtgtcatcgagatgagcggagtgaacatgcggtatgtgggggtcgacgacctgccatatcggccggacgtcatcgtctccgacgtctcgttcatctccctgacatatctgatggccgccattgccgaggtggcagcccccgccgcacagatcgtgctgctggtgaaaccgcagttcgaagtgggacagaaggggagactgggcaagaacggcatcgtcaccgatccgtcgttgcgagagcaggcactcgaacgggtggaacgctgtgcgcgcgaacacggtctgcaggttgtggcgagtgctccctctccgatcgaaggtacccatggcaatgctgaatatctcctctatctgcgtatgtcgcaatcgtcgtgattccatatgctgcgttatggaatataaaacgtggcgagcgtcggcggtgcgggactcctgcgaggagttgtggcgacacctcctgacaggcatctgtttcgatgagcggtgaattcgcttttggtcccttgtgttcctacaatggcttatgcaaacaggtgctgtcgcgtgccgttttgcggcatggaccgctgcgggcgcgccgcgacccagacctgcccgcagacgaaattgaccggtgacgaacaggaggacgcatggccaatctcttgttcgatgaatcggcatccaactccgagacctccaagggattcggttggtggttctctggtgacaccttcgaacgcaacgcctatgaggagcgcaatcctcatagccgttcgctgtcctatcgactgaactcgcatccgggtcgtctcaccatcatctacttcctcgcgctcatcacagtctcgacttcattgctgtgcctgccgatcgccacccagcccggcaaaaagacctcgttctcgactgcgttcttcaccgcggtttccgctctttccacctgcggcatctcggtggtgaacacgacggaccattggacgatcttcgggcaggtggtgctgatcttctcggtgcagatgggaggcttgggcgtcatgaccttcgcctcgctcattgccctggccgtcaaccaccatttgaaagccatgcaacggttgctggcggcgaatgaactcggcaccaacaagctgtcggagatccgcggcgtgctgcaggtggtgctcatgaccacgctcgtcatcgaggtcgtcacgttcttcgcactgttcccgggattgctctccgtaaacaaggggaacgtggggcgcacactgtgggagtcgttgttcttcgctgtcatgtcatacaacaatgcgggattcacacccgatggtgcgggtctgtacgtgaacaattgggccgttggtttgccgatcatgatgagcgccttctgcgggacgctcggcttccccgtgctgctcaacattttccgtacggcgcgcatgcacaaatcaccgaagcactggtcgctgcacaccaagatcacgatgatcatgaccttcgccatcgtattcatgtcactgatatggttccttgccgtcgaatgggataatccggtcctattcaaggacggtgatgtagacacccgcatgcggcgtgcgatggtggctgccgtgatgcctcggagcagcggcttcgatctgtcctgggtgccgggggtgaaggagtgcacgaaggtgttcatgagcattgtcatgttcatcgggggaggctccacttcgacggcgggtggcatacgcgtcacgaccctggctgtgattctgctggtgtgcaaggccgcgttcaccggccataccgatgtcaatgcattccacaaacgaataccgcagcatgtgatcatgaccgccatctcgattacggcctcttgcgtcgccttggtgttcatcgcctcggtggcgctcatgctcatcacggactcttcgttgagccatgccatgttcgacacctgctcggctttcggtctgggtggttacacggtgggtgtggcccaggagaacaatcctgcgtcgctctatgtgctggctgccgccatggttgtggggcggctgggtccgatgacgctggcctacgccgtgagcaggccgaaggaactcgacgtggtccgttacccagaaggccagatagtcgtcggctgatggattcgattccgcgacgggggagagaccccaccggcggatatagtggtgtgatgagataagcgcgtgttgcgcaggaaagggaggaacatgccggaaaaccgcagtgtgcttgtggtggggcttggtcgattcggaagtgccgtcgcgacgactctcgatgcgcttggacaggatgttcttgccgtggacaaggatccggagctcgtcaaccgatggtcatcgcagattcccaccgtgcaggccgacatgaccgacgtgctcgccattgagcagctcaacgcctccgacttcgacaccgccgtcgtcgccatcggcgattcggtggaggcctccgtcatcacggcaggcaatctgctggacgcgggcatctccgacatctgggccaaatccgtgtcgaaggaacatgcccgtattctacagcgcatcggtgcccgtcacatcatcaacgccgaaaccgacgccggcaagcgcgtcggccacctcgtctcaggcaattacctcgattacatcgagctcgaaggcgcctacagcgttgtcaagatccatacgccaccgcaattcgtcgggtatacgatcggtgaggcgaagattcatgacaggtacggtgtgacgattgtcggcgtgaaatcaccgggccatgaattccaatatgcttcgaacgatctgcaattgaaacgcaacgacgaactgatcatcatgggcaaacaggaccagatcgaccacttcattcggggctgactgagagcctgtgtgacggttgccgttccgattccacggaacggtgcctagcatgtattgggctatgatatgcgaagagcgtttgcgaggtgaagatggccaaggtacgacatgcagttgtggtgacccataagaaattgcgtgagaccggcaccattgtgcaagacacattgctgcagctcgaacgtggcggcttcgatgtcacactggtagacacggacaccattcccgatttcggcacgctgccgcagaccgttcctcccgaaaccgagatcgtcgtggtgctgggcggcgatggaaccattctgcgtgccgcggaactggtgcattgcaccgatgtgccgatcataggcatcaacatggggcatgttggtttccttgcggaattcgaaagcttccagctcgaggaggcgattcggcgcatctgcgaccatgattaccggatagacgaacgtatggtggcccacgtcgacgtgtggttgccggggaccaccgaggctttgagcgactgggccttgaacgatgtgacgatagagcgtgccgaccgcggcaagatggtggagatgagcatcggcatcgatggagtggccatgagctcgttcggatgcgatggtgtgatcgtctcgactcccaccggctcgaccgcctatgcgttctctgcaggagggccgatcatctggccggatgtgcaggctcttctgatggtgccattggccgcccacgcgctgttctcccggccgattgtgatcggttccacatcgacactgcagttcacgatccatgacgactccacttcaggcggctggatctgctgtgatgggcgccgtcagctggcattggcgaaggggacgcgcgtggagattcgccaatctgcaagcaaactccgactggcgcggctctccgacgtgccgttcacaaaccggctggtcaccaaattcaatctaccggtggagggctggcgtgaacagaacgcctccaaacatgaggacaccgacggacgcctcctcaccgatccgcagggaacctcactcaaaggcgaaggggatgaggtggatgagtgctaggagccgctcgtcagccgcatcagcctggccaactaagaggtggcacggtatactgtgaagctgcagatttcagcgatgccgcggcggcgaaaccaaccggcggcagtgtgagtagacgacatggatggtgaacatgcttgaggagctcgaacttcgagacctggggccgattgattcagcgacaatcactcccgcgccgtcgatgacggcgattaccggagagaccggtgccggaaaatccatgctactcaacgcattgcgcatgatttccggagggactgcggatgcgagtcgcgtggcatccggagcagaccaggcatgggcccaggggattttcgcgctgggggagcgggatccgttgcgtgccatgcttgccgaggcgggaattccggtcgatgacgatgggctcttcctctcgcgtagtgtgccggcgaaggggcgttcgcgttccgtgctatgtggcaaaagcgtgccgcgctcattactcggcgaagtggcgtcgaacctgatcaccattcatgggcaaaccgatcaactgcgcatcgcctcggttgcccgacagcgtgaattcatcgatgcctatgcccgcgatgacaaggcccgtgaatcgttcaaccaatcctatgagaaataccgcagtgtgtgcgagcggctgcgcaggctgcagacgcaggagtcgtccatgcgccagcaggcggactatctcagggattccatagcacgcatcgaccatgtggatccgcacgatggcgagctcgaggaactcatggaccagcgtgaccgcatcgaacatgccgagcagatcaccagcggtgtcgagcatgcgttggcatatttggatgcctcgcaattcgagagtgcggaaggcgcagccggtgttggtcagctcatcgccggcgcggtgcagtcgttgcgcggcatccatgcggtgggggattacgaacaattggccgaacgtcttgaatcggcaggcgctgaaatagacgacgtcgtgttctccctatcccgttccctcgatgcggacggtgagacaggtaatctggattcaatcaacgggcgcatccatgatctcaatgagttggcacagcgttgggggcccacgctcgccgacgtactccaatggcgtgatcgcgcgaagatcgacgtagaggatctcgacgcgtcgccggaacagttgcattccctggaacaggaacgtgaccggctgcgagatgaggcgatagcccgcgggcgggcgttgtcgaaggcgcgaaccgatgcggcgaatgcattgagcgcccaggtgaaccgtgagctcggacagcttgccatgtccggagcgaaactcgacatcgtggtcacaccccgcaacggggaagggatgctcgacgccaccggcatcgacgacatcgaattcctcttcacccccttcccgggatcggcgtcccttcccatgggcaaaagcgcatccggcggtgaactgagccgtcttatgctcgccttggagctctgtgccgcggattcctcacaggaatcggattcgtctcagaatgcgagcgcgggcatgacgttcattttcgatgaggtggatgccggtgtgggaggcaaggcggcagtggaacttggcagacgtctcgccaaacttgcacgccgtaatcaggtgatcgtcgtcacacatttaccgcaggtggcatcgtgggccgaacgccagtatgtggtgagtaaggagaccggtaaagagggtacacacaccaccgtgcgtgaggtgagcggcggtgaacgtgtgcgcgaaatcgcacgcatgctcgccggcagcgagtcgaagacatccctggaacatgcgcgcgagctactgcacgaatccgagattgaatagggggggggcacatggcgaatatggtgaatgcagccggagtcaacagtggaagggcggcgatcttcgacctcgacggcacgctgctcgactcgatgggcgtatgggacgcggtggatgtcgaattcctcggcagacgcggattcgacgtgccggcagactacatgcagaaggtgagtgcgatgcagttccacgacatcgccgcatatacgatccgcagattcggtctcgacgacacgcccgaggaactcatgcgggagtggaacgatctcgcctatgaggcgtacaccacgacagtcgagctcaagccgggcgcgcgggcatatctggaatggctgcgcgcaagcggggcgcggctggcggtggccacgtcgatgctcccctcactgcgggagccggcgatgcgtcatgcgggcatctacgatctgttcgacgtggtcgtgggcacgggtgatgacggcagcagcggcaaggacaacccggtcatcttcctccacacggcgcagttgctcggcgtcaagccagcacattgcaccgtgttcgaggatctgctcacggcggtggaatctgcgaaacgcgccggcatgcatgtgtggggagtgcaggacgactcctcggccatgcactgggaacgcatctgcgaaaccgctgatggcgtgctgttcgacttcacccaggcaccgcgtcagctcacatgattcaagaaaaacacgacagtccgattctcgttgactaatatgatggggccggtccctccgcggagggaccggccccatatgcatcgcgcatgactatagccggtcggcgcattcctcgacgtagtggcccatgtcgctcacctcgacgcagtcgcggaaccgcacctcggcattctccagattccgcagcatctgcggaatcggcgtgcctgatttggcgtgcaattcgtccatgcattcgaaatcggtgccatccgccttcagcccaagcgcctcattgaccacgcgcgggaacttgtacgggctggcagtggacagcagcacacgaggcacctgcggatccgctggcatctgctgcatcacgaaataaccgcatgcggtatgcgggtcgatcacatagtggttgcgatcccagcagtcggcgatcatctcgcgcacctgatcctcatcggcccaaccggtggcgaacaccttgcgaatctccatgagcatctccggaggcacctcgtaggttccccattcggcgagatcgttcatgagataggtgatcatacgcggatccctctcgctcatgtagtagagcatgcgctccagattcgaggagacgagaatgtccatggacggcgacgtggtctcgaagaacggccgcttgctgttgtaggtgccggtggtgaggaagtcgaagagcacattgttgcggtcggaggcgacgacgagttgacgtaccggcaggcccagcagtttggcgtaatatccggcaagcacattgccgaaattaccggtgggcaccacgaagtccacctggtcgcccacattgatcacctgctgttcaagcagctgtgcgtaagcggagaaataatagacgacctgcggtacgagacgccccacattgatcgaattcgcagaggaaaggcgaacatgcgcgtccgcctcaaggcgtgacgcgagatcacggtcgccgaagatgcgtttgaccgtggactgggcatcatcgaaattgccatccaccgcgcatacgttcacattggacccctgttgcgtggtcatctgcagttcctgaacgcgggagaccttgccctgcggatagaacaccgtgatgccggtgccctgcgcatccgcgaatccggcaagcgccgccttgccggtatccccagaggtagcggtgacaatcatgatcttctcatcgcaatccccgtccgccggagtggtgcgggccatcagccggggaaggatctgcaacgcgacgtccttgaacgcacaggtcggcccgttgaacaattccatgatgaagtcgttgcccagcggtttgaccggagtgatgcgctcatcgctccattgggagccgtatgcctcggcgatgcactgggaaagctcctcctcggtgtagtcgtcaagcagcaccgacaacaccgtcaaagcaatctgctggtagcttttacccgcaagatcgctgatgtcaatcttcgtctccccaagggcgtcggtgacgaacaggccgccatcgtcggcgatgcccttgcgtatcgcctgcttggatgtgaatgcctcgtcgctgctgcgtgtgctgtggaaagtgctcatgcgttactgtgtccttcgccgatagacggattgccgagtcacattataagtggagcgtatggagcacaccgacacgcgtccgtccaatggaacaaaccgttgtgcgctgtaggcaactgccattactcttgggtctatgacgaatacgaatgagctacagaccccggtgagcggcgacgtgcagcaggcagtgaacgcgctcgccgacgcggcggccatagcacaacatgaactggcgcaagcgaccgccgacaccaagaacggtgtgttgatggcgattgccgatgcgttggatgcgcatgcaagcgatatcgccgacgccaatgccatggacatgcaggccgcctttgacgcaggcatggatcagggcaagctcgaccgactcaaattcgacgtcatacgtgtggccgcagcggcacagggtgtgcgccatgtagccaccctgccggatccggttggtgagattgtgcgaggctatgatctgggtaatgggctgcgattgcagcagcagcgtgtgccacttggcgtaatcggcatgatttacgaggcacgtccgaatgtgaccgtcgacgtggcggccctgtgcctcaagtccggcaatgcggcaatactgcgtggcggccatgccgcggagcgcacgaacgccgctacgctacaggtgatagacgaggtgctgcaggaattgcatttcgatccggcacttgtggcatcggtcgaccgctatggccgggaaggtgcgcgtgcgatgatgcgagccaccggtcatatcgatgtgctcatccctcggggtggagccggtctcattcaatccgtggtgcatgagtcgcgcgttccggtgattgagaccggggctgggaatgtgcatatctacgtcgattcctctgccgacatcgacaaggcgatcgacatcgtggtcaatgcgaagacgcaacgcgtgggtgtatgcaatgccgcggagaaactcatcgtgcacagggacatcgcccggcagttcctgccgagaatggctcaggcattggcacgtgctcatgtgaccatccatgcggatgagctgtcgatgcggatcatgggagatgcagacatcaaggacatccaattgctcgccgccgacgaagcggattggggcaccgagtatctggcattggagattggcgtgcgcatcgtcgattcgctcgacgaggccattgaccatatcaaccggtactccacacatcacaccgaatcgattctttcccaggactacacgaacatcgaacgcttcacgaaggccatagattccgccgtggtgatggtgaatgcctccacgcgtttcacggatggcggggtgttcggcttcggcgccgaactgggtatttccacccagaaacttcatgcacgaggccccatggggctccaggagatgacgacgacgaaatgggtcggctacggcaatgggcaggtgcgcgcatgaacggagtgcaggaagggatggaatggttggatgaacgcgaagacggtgccggcggcatgaccgaggtggtgtctgacgcgcccgtcaacccgtgggggcttgacttggatgacccgttcatcgcgctccgactcactgccgagcggttgagcctggtgcggtatgtgttcgtggtgcagatcgaggacggcattgcgaccgcagggcagcgcgcgtcgcttgagtatgcggatgccgtgctcatcggttggccggacgagcacgcaaaaggcctggacgcgccgaccgatgaggaccggcgcaccatcgacgagcagattcgcctgatggaggagtatgtcgacaagttccgcacgatggaacaggatggcgatatcgacggcatgaccgacaccctcattcgcatcaccgaacgagtggcacgtgtacgcagcatctaccagcccaagttcctgctgcccacattcgcggaaatccgtcgtgtggtgcaggatgaatgggatgaggacatgggcaagatcgattccgacaccgtgatgaacgacaacggggagagcggtctggccaaggatgtgcaaaaagccgcccttgatgccgatgaagctggtcgcggcacggatcgggccagcgaatgaacggcaccacgcccatggatcggagcatgtccgagctgtcgccctatgcacaacgcgaggtggagctcgtctcgcagcacgggcgacgttcggctcggggcaactggcacgcccatgcgcgtatcggcatcatgggcggcaccttcgatccgattcacaacgggcatctggtggcggcctccgaagtggcgtgggtctacgaccttgacgaggtgattttcgtacccaccgggcgtccggtcttcaagcttgacaagcatgtgacgaatgaggaggaccggtacctgatgacggtcatcgcaaccgcctcgaatccgaagttcgtcgtctcgcgtgtcgacatagaccgccccggcgtcacctacaccatcgatacgctgcgagacatccgcgcccgctaccccgatgccgagctgttcttcatcaccggtgccgacgccgtcgctgagatcatgcggtggaaagacgccgagcgcatgttcgacatcgcccatttcgtggcggtgacgcgccccggttactcttcgaaggtcccgctgccggctggcaaggtagacatgttggagattcccgcactggccatttcctccaccgatgttcgtcaacgtgcgcgcaacggggaacccgtgtggtacctggtgccggatggcgtggtgcaatacatagccaagcacggcatctacgacgaggacgcgaagtagcggcacgtcaccggctctggtatcgcgccgctcagtcgaaacagcgatttatgattggacgcgtaaccgacgaccgacgtttggagacacggtgagtgcaattctcgaggggaaacccgataaaaatctcattctcgtaacaggcagggcgcatcccaagctggccaccgacgttgcggaccagctcggcatcgatgttctcgagaccaccgcctacgacttcgccaatggcgagatgtatgtgcgctacaccgaatccgttcgcggagccgacgtgtttgtgctccagagtcattgcactccggtgaacaaaagcatcatggaacagctcatcatgatcgatgcactgaagcgcgcttcagccaggtcgatcaccgctgtatgcccattgctcggctattcccgtcaagacaagaagcatcgtggccgcgaacccatctcctgccgtctcgtcttcgatttgctgcgtactgccggcgccgatcgcgtgatgagcgtcgatctgcacgcggcccagacccagggcttctttgacggacctgtggatcatctgattgccatgccggtattggtcgactatattcgcgatcgtttcgatggtcatctcgacaatgtcaccgtcgtctcgccagatgccgggcgcatccgtgtcgctgagcagtgggcgcaacgcctgggcggcggtccgctggccttcgtgcacaagacccgtgacatcacgcggccgaaccaggccaaggcgaaccgtgtcgtgggcgatgtcaagggcaaggattgcgttctggtcgacgatttgatcgacaccgcgggaaccatcgccggggcatgtcaggtgcttcgtgaagccggagccaggtcggtgaccgtggtggccacccatggcgtgctttccggaccggcagttgatcgtctcaagtcatgcggcgctcgtgaggtggtgctgaccgataccgttccgattcccgaggagaagcggtgggacggtctcacggtgctttccatcgcgccgttgctttcctccgccatcaaagccgtattcgaggacggctcagtggccgaattgttcgacacctaccctgaacatcacgggcagggattcctgttcgcctgattggtcgctgtgcagatgtgaaacacaccggcggcgaaaagtctgggcatatggcataatgaacacttggcggagtcactccgccgttcccccatggtgtaatggcagcacacgggtctttggaaccctttgtcttggttcgagtccaggtgggggagcaattggacgcctggtccgcatacgcggattaggcgttcgtcgtttataggtttggaggcattccatgacgttgaccgcggcaatcgtcctcgcagcaggggaggggacgcgcatgcgttcccgcaaaccgaaagtgctgcacgaattcgcaggaaagaccttcctcaacagggtcatggatgcggtcggggcgctcgatcccgagacgctcgccgttgtcgtgcgttatcaggcacagcgagtggccgaagcggcccgctcctatgatgacgctgtgctcattgtggaacaggatgagatcccgggtacgggacgtgctgtgcaatgcgcgatggagcagctcggggagcaggggcctctttctggcactgtgctcatcaccgcgtctgacatgccgctgctcgacacctccacactcaagcaattgctggattaccatcgtgacagtggtgacggagccaccgtgctcaccaccgtgcttgacgacccgactggatatggtcgcatcattcgcgatgccgacggcaacgtgctcaagatcgtggagcagaaggatggcaacagttccgaactcgcggtccgtgaggtgaacacatcggtgtacgtgttcgatgccgcggtgctcgaacaggccatcgccaatctgaatgccgacaacgctcaaggcgagttctatctgacggatgcgctcactgtcgcgcggcaggtgagcaaagtcggcgccttcgccgcgcccgaccccttgagcgtcgagggcgtcaacgatcgtgtgcagctcgcgtcgctggccaaggcgcacaatctgcgtgtatgcaggcagtggatgctcgacggggtcaccatcgtcgatccgcagaccacttggatagaagacgaggtcgagatggagtcagatgctgtgattctgccggggtgcttcctgcagggacacaccacaatcgcccatgacgctgtggtcggcccctacaccacgctcatcgatgcgacggtcgagccggaggcccatgtggagcgttcccgcgtgcaggagagccgcataggccgggaagcgaacattggaccatggacgtacctgcgtccgggaaacgagatcggcactggttcaaaggcgggtgcattcgtcgagatgaagaaggcgcacatcggcgatggcagtaaggtgccccatctgagctatgtgggcgatgccgatctcggcgagaacacgaacatcggaggcggcaccatcaccgctaactacgatggtgtgcacaagaaccacacccatattggttccgacgtgcatatcggcgccggcaatctgttcgtcgcgccggtcaatgtgggggacggtgtcaccagcggtgcgggatcggtcatccgacatgatgtcccgggcgacgcgatggtgtactccgagaacacgcaacatgttgtagacaactggaaaccagcttgggagcgttgaaatgaatgctttggaacaatccatcaattcggtgcgcgtcgccgcgactgcggccgatggcatgaaggcggaggacgtggtggcctacaacgtgggcgacaaactcggcatctgcgacctcatgatgatcgcctccgcttcgaacgaacgtcaggttctggccattgccgaggaggttgagaagcagctgttcctcaaggatggaggccgtaagccgcggtccagggagggcgtcgaggaggcgcagtgggtgctgctcgactacggtgatttcatcattcacatcatgcatgacgaggcacgtgacttctacaatctcgaacgcctgtggcgtgattgtgaaccggttgacctcgaactggagcatccggaaagccggggcatcaagtccagcgacgccgataccgaagagtgacggcggacgaatggaaccgtacgcacgccatggccgcacctcatacaacagacacaagggctggtgcagggatcgatcgacattccgctcgatgaggtcgggctgtggcaggtgaaccagtccgcgcagtcactgattaagctatatgtgctcccagacccatctcggcaccagctcgttgtgtcctccgacctcgaacgttcgatgcagacggcacatgccttcgccgatagactggggtccgaagtgcatgccgacgaacggttgcgcgagcggcatttcggtgaattcgaaggccgatccggcgcatacctgcaggccaatttcccgcaggacttcgactcgtggtgccggggcatgggcggcgagatgaatcatggcgccgaatcccacgaacatgccggtgtccgcagcatggaggccatgaatgattgggcccatgaatgcgatgacgacaccgacttgttcgtattctcccatggcgcgctcatcgaaaacgcgctgcaggtgctgttcggcatcgaacgacgatacccggatttcacgctcacctcgatgtgcaacgcgcactgggccagactgagaagggccgatatcgacatggacagccggtggatcatggaggactacaaccatggacccgccctggccgatacacagtattgggagcgcccagacactttgccagcgaaatgacaggacacctcaagtcttggcgtgtatgctgtgaagacgaaaactatgaggcgcggatgacgaacgcgcctccaaccatatctgaacattgaaagcaccgtgaaaaacttcttcaaaggaatatcgttctcgcagctgctggcaggcgccttggccgcggtgacatcgtttctgctgtcgtcgaagatcggcatcgcaggttcggtaatcggcgtggccgtggcctccatcgtctccactgcggcttcccagctctatcagaacgtgattgacgcgtcgagcaagaaactccaggatgccgcacaacaggttggggttgctccgccgcatgccaatgcacatacaggcgaccactccacggccgatatcgacgacacacagaccatcgcacctgtacattccgatagctcccgtggcgcacgcaccgtggtctccggaacccatgccaccgatgcttcgaagcacccgcaggctggtacgaagccgcagatgaccaagcatgacaaacgtgtggccgtgattgtcgcactgatttccggtctggtggcggtgggcatcaccgcaggtgtcatcctcgccttgacgggaggcaagggcaccgactccgtggtgcgtgacgtggtcagccccacttactcgcagacgccggccgagatgcccacccagacgcccacacagacaccggcgcccacgcagagcggagagggaagtgataccgattcgcgtcatacgaaggattcttcgacatcggacaggaatggacaatcctcgggatcctcttcgggcaatgcgaatactggttcggggaactcaggctctgactcatcgaaccccggatcctcagggtcgtccgggtcccagaactcgaatgggtctgggactgcgggcaccggttccgctggtcaggacggcaattcgggtgatacgcagaacacggattccggcaatggtgattcgggaggttccgtcaatgacggaaccaattcaggcaccacccagaagaaagacggttcgcaagctcagcaatagtaggcatatatggggatggccgggaatcgattcccggccatccccatatatgctccgcccgaacgcgtcaatgcgacacgccgatttgctcatcgaaacagaatgttgtaatctagcacaggttcgttcgaagaacgacggggctatggcgcagctggtagcgcatctccatggcatggagagggtcaggagttcgaatctccttagctccacgaatcgcaggcaatctgcgatggcaggtatgtggtatacacctgtttggggctatggcgcagctggtagcgcatctccatggcatggagagggtcaggagttcgaatctccttagctccaccaccaacccggctatgccgggtttttgttttcgtcttctgaagtatcacattccccatatccttccacagcgcaaacccgaatatgccgccatgtcatcgcgtagtgtgatagtcatacatgacgaaaggaacatcatggcgcaactgactgaagatatgaaggaattcatcaagaacaatctggcatgggtggcaaccgtgaaccaggacggcatccccgacctcggtccgaagatgtcgatgttcgtgctcgacgacaaccatcttgcctatcatgagcgcactgccggacagacctaccgcaacctcgagaacggcagcccgttggtcgtggcgttcgcgaacttcgaacagaagaagggctaccgcttccgtggtgaagtggtgctgcacactgacgacgccatttacgacgaacaggtcaagctcgccaacgaacgtggcaccaaggttcccgcctgcgtcccggtgctggagatcagcgagatcgaggacctctccgcaggtgcaaaggccggcacggtgatctcgcacgactgagccatataccgaaaatgccgaagcctgtcgtctggcttcggcatttttgttccatgcggatcgatgccgggtgatgggaacagaaaggacgggaagaaatgatcgatgaagtgatgttcatgcgccacgggcgcaccgcattcaatttgcaacggcgcttgcaggggcagatcgacattccactcgatatcgtggggcagtggcaggtggatatgagcggattcacactcgcccaacggttctattgggccaaggtgtcgaatatcgcccggcatccggacaggctttcccagccctccgatcccccgattcgtcgcagcgacatcacggaatatgagcaagcccctgcgtcgcgacgccgcatggtggtcgtgagctcggatctcttccgggcccaacagacggcccatgctttcgccgacccgctgggattggacgtgacactcgattcgcgtctgcgcgaacgtgatttcggccaatgggaagggatgagccgagaggagattaatgagcggtacccggaaggatatgcgtcgtggaaggcccatgagggcggcgaggcggcctatggggtggaaagccgtcccgaccttggcaaacgtggcagttccacgatccgttcctattgcgacgacccccagtacatggatgagcccaccacgttgttcgtcgtctcccacggttcatggatcgccgcaaccattggaaacctcatgggtctgccagattcgcagcttgacaatctgaccggtatgcgcaatgcgttctggagtcgtatggaaccccagtacacttcgaattccgtgctgttccatcttacggaatatgacaaggggccggatgtggcggacgccgttgactgggagaacggcccggcgtacctgcgcaatccagacatgccgatgtggaaaccgctgatttaggccgatgctgcccggctgtctcaaccctgcgactatgctggtgcgttggcttgaaagcgaccgtgacgcatgcaccccttacgtgtggcgtcgcgggtccagtggcgaatgccggacacgatgaaggcgggtgatgccccatgttgcgtatgttcagtaccgttgacggccaggtacggcagatttcgaaaccagagaacggctcttggctggcgttggccgatcccaccgatgtcgagctcgccaccgtctcgcaggagacgggcatcgacctcgccgatctgcgtgccccgctcgatgacgaggaacgttcgcgcgtggacgtggaggatgactacacgatgatcatcgtggacattcccaccgtggaggaacgcagcggcagggattggtacgagacgataccattgtcgatcatcgtgacgaagacgatgatcatcaccgtgtgcatgcaggacaccccggtgctccatccgttcatggaaggcacgatccggggattcaacactttcatgcgatccagattcattctgcagatcctctatcgaaacgcgacgatgtacctgcggtacctgcgcatcatcgaccgggagaccgataaactcgaactgcgtctacgccactccatgcagaaccgcgagattctcatgctgctcgaactgagcaagaccttggtgtatttcaacacgtcgctcaaatcgaacgagatcgtcatggagaagctcatgacgctcacacgcattaagcagtacccggaagacgaggatctgcttgaagatgtgatcaccgagaacaagcaggccatcgagatggcgaacatctacagcggcgttctcgcgaacatgacggacgcgttcgcctcgatcgtgtcgaacaatctgaataacgtgatgcgcatcttcacgatgatctcgatcacgctatcgattccgactctcattttctccatgtatggcatgaacttccaacaggggatgatcggcatgccgttgagcgattcaaaatgggggttcctcgtcatcgtcctgcttgcctgcgtcttggcaggagcggtgatctggttcctcacacgctcgcgactgttcaagtgaggcgcgccatgcatgcaagactgagaaccatctcccgtgcgatcctcacaatctctctcgcagtggggctttgcggctgcggcacctcggtgaatgtcagcgccccggggcaggcgaaggggccggtcatgtcgatcggcgtgccggccgatgaaccgggggttggttggtaccatgacggcgaatacagcggtctgagtgtcgaagtggccaaatatgtggcaaaggtgctcggctatggggacgagcagctcttcttccactcccagacccccgccacgcgcttggacaggcttgacgatggtagcgtcgatttcgctatggtcacgttcgcctatgacggtggcaagaatgcgttggagatggaccatacgcaaacggcggatggcacccggtacgaggtctcgggcccatatctggtcgctcgcaaccaactgctggttcgtgccgatgacgcacgtcggctgccggatgtgcagtcactcgatggcaggaccgtgtgcacggtcgccggcgagtattccggggaacaactccatgaccgtcacccacggatcaagatcctgcaacgtgccgactacagcgaatgctcggcatcattgctggtgggccagagcgatgccatagccgggccacagccgattctggcgggactgcgcaaggacggtggcacccgatacctgcatctgcaggaggacagctacggcacccaggctttcggcatcgcagtgaaggcggaccagcgcaagctcatggagctcatcgacaccgccctgcagcagatggtcgatgacggcgcatgggacgcccagatcgacgcaatggaaaccgagttgggtatgcatgtggatctgagtctcaatccggtgacggttgcacgctcgcaggacgacgaataacgggcgcatcccctcccggtgcaaccgggtcgactggtggacatgacgcccccactgtccagttgcgtcacgataatcgttgcctatgagtgagaacgatacgaacgcgcaagcaacatcgaatgcgccggctacgccacaataccgctatacgacggaaatggcccagcgcattgaggagaaatggcaggacatctgggagagcgagggcacgttctgggccgcgaacgtgagcggcgaactcactgacagcaagggacgtcatgccgatggccgtcagtccttcttcgccatggacatgttcccctacccttcgggcaaaggattacatgtcggtcatccgttgggatatctggccaccgatgtggtgagccgataccatcgcatgaagggcgagaacgtcctgcacgccatgggctatgacgcattcgggcttcccgccgaacagtatgccgtgcagacgggccagcacccgcgcatcacgaccgaacagaacatcgcgaatatgcggcgacagttgcgccgcatggggctgagcttcgacgaccgccgctccttcgccacgatcgaaccggaatacgtgcgttggacccaatggatcttctcacgcatctacgatgcctggtacgatccggatacgagaaatccgagtggatccatggggtgcgcgcgcccgatttccaccctgatcggacaattccgcgccggcacacgtccgattgacggacatgaggacaaggcctgggatgaactcaccgagatggagcagaccgaggtgctcaatgagtaccgactcgcctacatctccaaatcgcctgtcaattggtgccctgggcttggcacggtgctcgccaatgaggaggtcactgcagaggggcgttccgaacgtggcaatttcccggtgttccagcgtgagcttcgtcagtggtcgatgcgcatcaccgcatacgggcatcgtctcatagaggatctcgattccatcgactggcctgagaaggtcaagctcatgcagcgcaactggatcggggagtcgcatggcgcctccgtgcatttcaaggtgccggtcgacggtgagatggcagatatggagatctacaccacacgacccgacacgttgttcggtgccacgttctgtgtggtctctcccgaacacccgatgctggagcatgtgccccaatcctggccggaaggtgtggacccggcgtggacgggtggctatgccacgccgagcgaggccgtatccgcataccgtgagctcgcggaggcaaagaccgcggccgaccgtgtggccgacaacggtgagaagacgggtttgttcaccggcctgtacgcgatcaacccgatcaccggtgccaagctgccggtgttcacggccgactatgtgctcatggactatggtaccggtgccatcatggccgttccgggcggtgaccagcgagactacgatttcgccgtcaagtacggtcttccggtgatctacacggttgcgccgctccctgattccggtgacgatctggccaattatgagggtaccgccccgttcgtttcgcatgacggcatcgtcatcaattcagccgtcgacgcgacgtgggcccgtggcgacgcgctctgccttgacggcatgcgtgtggatgatgcgattgctgccgtcaccacgtggctcgaggaggcccaggtgggcaagggggccacgagctaccgtctgcgcgactggctcttcagccgccaacggtattggggtgagccgttcccgattgtctacgatgagcatgaggtgccccatctggtgcccgacagcatgctgcccatcaatctgcccgacgttccggattacagccccaagaccttcgacccggaggattcccagtcgagtccggaggccccgttgagccgcaacgaggattgggtgaatgtcacgctcgatctcggtgacggtccgaagacctaccatcatgacacgaacacgatgccgaattgggctggttcctgctggtactacatgcgttacctcaatccccatgacaccgagcacatggtggagcgcgacgaatacgactattggatgggtccgaagcactccccggcggccgggcaggccggaggcgtcgatctgtatgtgggcggcgtggagcacgcggtgctacatctgctctactcacggttctggcataagatcctgttcgacctggggtacgtggattcgttcgaaccgttccacaagcttttcaaccaaggcatgatccaagcgtatgcctacaccgatgaccgcggtcagtatgtgccggccgaggacgttcaggagagcgaagtggacggcaagaccgtgtacacctacgaaggcgaaccggtcaaccgtgagttcggcaagatgggcaagagcctcaagaacatcgtgaccccggactacatgtacgaccattacggcgcagacacattccgcctctatgagatgagcatgggaccgcttgacgagtcacgtccatggaacacccgcaatgtggtgggcggcatgcgattcctgcagcgtttgtggcgcaatgtgattgatgagaacaccggcgaggtcacggtgaccgacgacgcgatggacgaacgtacgttgaaactgctcaacaatacgatcgccgaggtgaccggtgagatggaggccatgcgtccaaacaccgccatcgccaaactcatcgtgctcaacaatcacctgaccggcatgaacggcgtgccccgcgccgccgtggagccgctggtgctcatggtggctccgatcgcaccgcatatagccgaggagctgtggaaccggctcggccatgatgagtcgttggcccaccatccatggccacaggccgacgagcgttatgttgggcaggacaccgtcaccgccgtggtgcagatcaaaggcaaggtgcgggccaaactcgaggtgagtgccgacatcgacccggatgaactggagaagatggccttggaggctgtggctgagcgtcttggaggcaagccgccgcgcaaggtgatcgtcaaggccccgaagattgtttcgatcgtcccgggcgaatgatcgcacgcaggtcgtgcacctgtggatgacctgcgtggtggatatcacgtcctccgaccacaggtggccgtcctcgttgcaatgcccatgccgtcatgattaagtggcggcatgggcattgtctattccggacggcgtgaaagcccggacgccgtcatcgtgctgagggagggggctgtgacgcggctgcgccatctgggagggccatcgtctcgcagcatggcagccggttcatccaccggtccaggcttcagcattcagatgccgtcggtgcccctgccaccgcctcccggtgtccaggagccatcggtcacggcaagcaacgagcaatcatcgggtggtgtgagggaagtttctggagatgaccagaaggcgggcgcactgctgtcgagcctgaccgtggtgaacgacgacgatttcgaagcggaacgtggagtccgccgtctggaacgaccccgattcgaactcgaaccgaagcatgcgctgctgtgcatcatggtgttggtctgtgcgctggccaccaccctgaccctcctggtgcagcaggccgccaacatgggcgccttggacacgcaggccaccacaaacgcgtcatctcatacgacggccacggcatcgccatccgaccgggattcgacgccttccacggctgcaccggagccgtcgccatcggcatccgacaacaagcaggacaccttggtgaacatcaacacggcagacgaggcacaactgcaggagatcaagggaatcggaccggtgacggccgcgaggatcatcgaataccgcacccagcatggcgccttcgccagtctcgacgacttggtgaatgtgccgggcatcggcatgaagaccgtagagaagctgagaccatgggcatgcgcgcaatgacggcaccggcatgcgaccgggagcacaggggaatcgcaggcagccgagacctgcgcatgctgccggtggctgcgggcgtttggagcgccacactgctgacccgatgggtatgctcccaacacggatcggggcacgacgtcttctggcagcatggccgcatgctgcaaatggcgtgcctggcggtggcatcggcagccatcttcatcgcactggtgctcattcccctcacgatgaacggggcggggaaacaccatggattggccgtggatcgcgcccaccggatgctgtacacactgctaacggtctgtttcgccatactcgcggccacacttgccacggcggcgcgaagcctgacggagcatgccgacccggtgaacatgtcggcatcttcctccacggagcgtgtgaatctgacgttcacggcgcattcactgccgttggcgacgtcgatggggggatacgactgccaggtcgacggcaatgcccggtccatcgttcgccatgacgttcgacgtccatcgtcccgcggtgtgcgggtgttcgcccgacagccggcctgtgggcgcatcgcgcagcagggggactacgccatcgtcggaaccatccaggcggcggcatatggtgagatgcccatatgggtgcttgcagacggtgacatgatggccgtcaaggagccaccggcgccatggcgtgcggtacatcggatacgcatggcattcctgcaaacgacccgcggactcgacaatccgggcgttgtgttggttcccggcgtgaccctgggggtgctcggacacgatgcgatggtgcactgcgcagatggtggagtggaggacgaatacgccgaactcctgcaagagcagtgtcgccgtgcaggcatcatgcatctcatggccgtatccggaggccattacgccctcgtcggcacattggtgatgggattgggggcacggctccattggaaccgttttgtgaaggcaggcgcgctcgcaatggtctacccgatgctcacgatggtgcttgcccccagcaggtcggtcacacgggcgatgctgatgtcgatgctgtctcttgggttcctgatgttgggccgtcgtcggcaaagtgtgcatctgctctgcctgacggtggtgttcggattgctgctcgatccgtcattggcttcgagttacggcttcgcgttgtcatgtgcggcggtgttcggcttgtcgacggcatgcacgcgtatgacggcatgggtgtcgcatctgctaccggaccgtttggccaagctgttggcggcttcatgctgtgcacagctattcgctggtcccgtacagattctcatggacaacgaggtgtcaatatggtcgctgccagcgaatctgctggttgcaccattcgtcgatgccgcgacgattctggggctgtgctcgttgttcgtcgcatggatggcgccgggcgtctcacgattcctggcatgggcgtgctcacaatgcacgacggtcatcgaatatgcggcacgtctgttcggctcggaggagtcgagcaccttggcatggatggagggtatacccggcgctgcggtgctcatcgtgacggaactgaccacatgggcgctgatcgtatgcatcggggacctgctgcgagcctatgacgacacggtcaccaacggtgatggccgtcccatgcgcatgccggtcagggaacgcctcacccaatggttcgaacatacgctcgaaatgatggggtggctgacatggcgcagatgagacgaaggatgcaggcaaaagccggtgtcgcaagacttgtccaaacatacgtcgacattgaagatatgaccgcagcaacactatgcctgctcatctacggtggcgatgagtacctgaacgaacagaacgcccgggatgccgtgtatcgcctgcttgaggaacatagggatgccgaattggcacgcgtcgacgcccgcagcgccgacgccaactccttcgacgaggcggtgagtccctccctgctctcgcagaggtcggtggtgtgggtcgaacatgcggaggacgccgactccggactgctcgacgccatcgtggcctacgccaacgaaacaaaccgggacccagaagcgtcgccggtggtgatgcaatgcgccgcaacgctaaaaggccgttccgtggaagcgctcatgcgccgcaacaacattcccgtcgacacggttcccaaactcgacaaggccaaggacaaactcaactatgtgtaccagcagttccaatcgcgtggcaggcgcatagacccgcaggccgcacagcaactggtcaatgtgctcggcgaccatgtgggagagctggccgccatgatcaggcagctatgcttcgacttcgatgacgacccgatgcgagtgaaccgtgtgaaccaatacctcacagggaaccccaaggtcaccggcttcaacgtggccgacctcgccatgggcgggaaaaccgcacgtgcagtgatcgccctgagatccgcgctcgcccaaggaacggaaccgattgcactcatcggcgcgctcgcgttgcaaatgcgcaacctcgccaaagccgcggccattcgtcaaggggacatctcgaaaaccaaggcggcggtgaacgaatgggcgctgcgaacggccaacggacgtctgggagggtggacatcgcagggcatcagcgcctgcatgcaacgactcgcctgggcggacgaacaatgcaagagccgcggaggcgaccccatatacgcacttgagaacaccatagaactcatcggagccaaaggaatccaatgaacaccatccaccatatgctcgagcccaacccgtcacccgcaccacgacaacctgacagcacgattaccttgcaagtgccgaccgcacaggccatgcacgagctgggcgagcgactcgcccgcagcctgcacggtggtgaggtgatcctgctttcagggccactcggcgcaggcaagaccacattggcgcaaggattgggggaaggcctgggcattcaagaacccatcgtctcaccgaccttcaccatcgccagggaactcgacggcaccctcgcggacggcactcccgcacatctgatccacgtggatgcctaccggcttggatccaatgactacgccccaggtcaggcacaggccgacctgctcctcgacgaactcgaatccctcggcctcgacgaggaactcgaagaaccgggcacacgcaccatcatcctcatggaatggggcgaacaaatggcagttgcgctcgccgacgaacgcttggagatccgcatccaaagacccaccgaccatgtgtctgcccccataggccggaacgaacccaccgcagatggtgaacgcatcgtcaccatcaccccagtgggaacacgattcgccctggcggaaccagccgacacccaagcctgacgacgccgacgggcaacgcatacgatacaagaaccgcactctaacacaacacacgaaacaagcgacacgagacacatgaacacgttagtcatcgacacatcattcggatccacagtaggcataaccgggcatgaaccaatctgcgaacaggattcgcgcacacacgtggaaaaactgcagcacgacattgcgcaagtctgcgcagaggcgaaaatacaaccccacgacatcgaacgcatagtcgtaggaataggcccggcacccttcaccggactacgcgcaggcatcgtggcagccaaggcaatcgcctatgccaccggggcacaactcctcggacaggattccctaagcggacaggccgccatgatgcaagcggcctacaacggcgatccgaacctgctgaacacagccatattcggcaactggaatacaccagccaatgcgggcaccgcgttgcacctgaccctcagcgtcaacgacgcgcgccgcaaacagctctactacaccctgctcgcaaacaccaacgcagacaccaaagacgaacgcatccaactcgacatgaacataggcacgccatcgaacatcgcggccaaagtaagcgcagcggtcgccaccatacagcaacgccatcccgaccagccggtcgccgtcgacatcgtcggacacggtgcaagcaaatacgagcaaatctggagcgaacaaccctggcacggaatcaccctcgaccattcactcctcgacaccggcgcatggggggtgaaaaccttcgcagcactcgcagaacacgataccgaagccgacgccaatccacgccccatcgagcccctctacctgcgcagacccgacgtcagcgtgcccaacccgctcaaacatgtgctcaaccacgaaggagcacatcgcaacgaggcaaacgcatgatcgtcgacgccaacacgctcgaccgcgccacggtatgctcgcaaatagccaagatggaactacaactgttcggcaaaggggcgtggagcaacacactcatagatgaagagctcagcgcgccacaccgcagctactatgtgaacgtggacgaccaaggaaccatagacgcatacgccggcctctggtacgacggatatgacgcacagatcatgaccataggcgtcagccccgaacgccaacgacaaggcatagccacccaactgatcaaccagctcatcgccaaggccaacgaactccacgccgaacgcatgctgctcgaagtgcgcgtcgacaacgaaccggcactcaccctgtaccgccacttcggattcgaaaccatgggaatccgcaaacgctactaccagccggaaaacaaagacgcctacaccatgagcctcaccctgcgcgattcccgacccgcaggcttcgccataccattgaacacacaatgctgatcccaacagcgccacgccaacaagcccaggaaagaaaacaatgagcaaccaaatcattctcggcatcgaatccacctgcgatgaaaccgccgccgccgtcgtgcaaggcaagacactgctggcgaatgtcgtcgcctcatccatggacgaacacgccagatacggcggcgtcatccccgagatcgcctcccgagcgcacgcacagtcattcgtaccggtggtatcgaaagcgctcgccgacgcgaacatgaccatcgacgacgtcgatgccatcgccgtctcggcgggtcccggtttggcagggtgccttgcggtcggcgtttcgggggcgaaggcattggcctggtcagccaacaagccgatctacggcatcaaccacgtcatcgggcatgtggccgtcacgcaactacagttcggcgacctgccggccaatacgatggcgctcatcgtctctggcggacacacctcgctactgcatgtcaacgacatcgcgcgtgatgtcgaggtggtggggacgacattggatgacgcggcaggagaatgtttcgacaaagtggcccgactgctgggattcccatatcccggcggcccatacatcgaccggcatgcccagcatggcgatccgcatgccatcaaggtgccgcaaggactcacgcaaggtcgcgcgggcaaggagcatccgtacgatttcagcttctccggggtgaaaacagccattgcccgttggatcgaggaacggcaggggagcgggcaggagattccggtggacgatgtatgtgcgtcgctggctggatcagtggcacaggtgctttcccgaaagagcatgcgaggatgcgagcagttcgattccaccacgttgattgtgggcggtgggttctcggcgaactcgcagctccgggaggcgctgatggaggttgggtgcaatcacggggtcgacgtgcgcataccgcagatcaaactgtgtacggacaacggtgccatggtggcgatgcttggttcgaatttggtggaggccggtgtggcgccgtctgacatggaattccccattgactctgcgatgccgcttaccaagatctgcatgtgaggtattgcagtggttatctccggattggtgcggcatcccgccggggatacggtgcgacacgcgttgatttgcatttttcgactcacccgctaaactaaacatctgttgcgtgtgagagatcatgcgagcgcattcctgcgtagctcagttggcagagcatccgactgttaatcggacggtcactggttcaagcccagtcgcaggagccatcagccgccctcgggcggctttttcattgtgtgccagatacggtgtcgcgacgcgactcattgaccaattcggtcagctccttgagtctgtcgtgatgagtggtgtaccagcctgtgttctccatgatgcggccggttcggcgctgcagttcctcgacgctgtcggcattgcacccggtgatttccggggccttctcctcatattccttggcgaattgcacgagcacattggggtcctgcacgtcataggtgccaagatggtatgccttgcttgcctcgctatcgtgcaggtatgtgtaggtgttcatcgcgatgcgcagtttatcgcttgccgcggcgcacatatgtctggcatgggtgagatgggagacgttcatgttgtgcacgatgagtgcggcgccggctgcgaagacaatggcaagacagagcatgacgatgatcgatgcattccgatgtgtggatgatgccgtgctgctggtgtcaccatggtcgtcgctggatttcggcatattcggctgcactggctccatattctccctgattgggtttgcggggcataagaccgtcgcatattgtgcggatttctctctatgttgcattctacgcgcatcggagaaaatgacggtcgtgccatatgaatccggggagtatgccgacacgccggatttgcgtattcaaagtatcgtgtgtaaattatatgtctgttgcgtgtgagagatcatgcgagcgcattcctgcgtagctcagttggcagagcatccgactgttaatcggacggtcactggttcaagcccagtcgcaggagccatcagccgccctcgggcggcttttttgttatacaggaggtgggtgtgcgcgtatgagcaggaacactgatgaccggcgtgctcttgcagcgatcgagagcgaacgcatggaagaccagatcgcttattaccgtaagcccttcatggtgctgtgggcggctgttcaggaggcttcgtcggaattggaagaggattatggactctcttccgacgtctcgcaactctgggtggctgaacggctgcggcaggtgtcggattcattggtggacagattggccgagaaagccgtgcaacatggcaccagcaaatcgaacgtggcacgtgccgccgattcggatccaacgaatgccatgcgcagatttcctcgtcttcgaccgggagctgttcgcacccgactgcttattgacgaggtgctcgattcgctggaatgacgtcttcggattcgccatcgacctttcccatccttctcggcaatgagtgcatgccattgacggcaatggggtgatggcataacccgttctccgaccacaatgacctgccagactggacacgtggatgctaaccagtcatagtggaatccagatcactacgtggctggaggagatatggcacatcatgggacttcctgggatgggtggcgtcgatggcgggctcgcagactcaggatggtgagattgtggatgctgcggttgctgcggatgcagcatgaactgctgattctggcgctatgcctggtttgcggtgccgttgccccgctcgctgtctcgtcgagtgagattcatggcatggagctcgttgctggttgtacggcaatcgcaggggaaatgtgccatgctcgcatgctgtcgcccgtgcccgatggattgattgtcagggggttcgaccggccggaatggcaatggagccctggccataggggagtggatatctcgttgaatggtatgcatgagttgctggcacccagcgatggggccatcagtttcagcgggatggtggcggggaaatcggtggtgagtatcgacacaggtccgtacacgctcacattcgaaccggcgcacactcaactggcggtgggcgacaaagtgcatcgcggaaagcgattcgcctcggtcggaggccagagcgaccactgtggggaaagttgcgtgcattggggtgtcaagcgcactgggcgcagggactatctcgatccggcgtcattcctgcgtccaatgcagattcggctggttccctattccgaatagcgtcccaccggcacatcacatcacatgtcggcgtcggccaatgagatgtatcccggatcgatcaatgcggccttcagatttgcggcactcacggccagcagggtcatatgcagtgtggggatctccgaaccgtagtcgtcgctggttttgagctcggcaatgttggagagcttctccttgcggttgagctgcagtgcgatttgtgcaatggtgccggtgttggcatggacgtccaccagaccggtcatccactgcaatccattcacaatgttcgggatatcggatatataggcaccaaaaccggtgataatgggccattgcttggagtccgtcttcgttgtctgggatggttgcgcggactcatcacctgactgtgccggatcaggcacacgttgtctgttcagtggcttccttcctgcaatgttgcccaccacatcgaaaatggtgatggaggggttgacatccatggaggatcctgaatagcccatcgttttcagtgccttgatcgatgcggccgcggtgaaatcgttcatcgccaggataccgtcgatgcgtacggcagcatcgcgtcctttcgtctcgaggcgtgacttgagctcatcctctatctgggagtccttcgtcgccttgaacatcacatccttgtaatcgcttttcgtggtgaagaacgagaggcgttgtgaggggctatatgccttgcgctgccggaaatacggccccagaacctcccagatgccttcaaacgcctgcgcttggaacgaattgtttttgccggacgggtcggtgttcggcaggagcacctctatggctttgggattcgactcgctcaccgcatcgagatcgagtttggatacgatctgctgtgcctgcatacggccgatatcagcggcagtcaccaatgggacgtagacgttcggaacgaagccgtcgatcgggttgcccagcaccaccacatgcatccccgcgttcttcgccttgttcagcgaatcggctatctggcgcatggaagaggattcatctgagtcagtgtcagatgcatcctggtcggagggctcctggttcggagtggtgatgaaatggctgtattcgccgtagttcctgtcaagcctgacggccggggcgatgacaatcgtcgttgccccctgctcggtttgcgggtcgccgtattgctccttggaatccgcattgagccgttcctgcacataccgcttcaaggcatcgctctggcttgccaacgaaccgctggtctcacggttcatggacttgccggagaatccgccagtggacagcgcgttctcgagcgaatcattgagggtgttccagttgttcaggggaacgttctgcgaaagattaggggagttcgatggaaggaagagcgccacgtgccctgtcgaagctgcggtggtggccgaggggctggtggtggcggtaccggtcaatggatcggtggagcatccggccgttgcacacatcagtgagccagccatcgccaacgagacgaatgcgcgaatgatgtgagaggtgcctttgcccataaccgcccttgccctttgcctagatcgcagcgtatgccgttacattgtacccgacctgcaacacttcggggcctgtgcatacgcacaggccccgaatgtcgtgaggatgtcagattcaacgctgctcggcaaggttcctttgcaggttctcatccagggcgttcatgaactgctctgtgtcgagccattcatggcttggatcgatgagtatggccagatccttggtcatctggccgccctcaacggtcgagatgatggtctgttccagtgtttccgcgaaattggcgacctgtggggtgccatcgagttttgcgcggtgcttgaggccaccggtccaggcatagatcgaggcgatcgggttcgtggaggtcttctcgcctttctgccagagacggtaatggcgtgtgaccgttccatgggcggcctcggcttcgacggtttggccatcgggagtcatgagaaccgacgtcatgagtcccagcgacccgaatccctgtgccacagtgtcggactgcacatcaccgtcatagttcttgcaggcccacacgtaaccgccatgccacttgagcgagctggccaccatatcgtcgatcaaccggtgctcgtaggtgagtccctcctgctcataacgttgcttgtattctgtttcgaacacctcggcgaaaatgtctttgaactcgccgtcgtaggccttgagaatcgtgttcttcgtggagaggtacacggggtagtgccgcaggagtccatagttgaagcatgcgcgtgcgaagccgcgaatcgattcatcgagattgtactgcacctgcgccacgccgctcccaggataatcgaacaccacatgttcgatcggcccggagccgtcattcggggtgaaagtcacggtgagagtgccagaagtcggcaccttgaagtcggtggccttgtactggtcgccgaacgcgtgacgagccaccacaatcggctttgtccaaccaggcaccagacgaggaatgttgtctatgacaatcggctcgcggaagatcgtaccaccgagaatgttgcgaatggtgccgttcggcgacttccacattttcttgaggccgaactcctccacacgcgcctcgtcgggggttatcgtggcgcatttgacacccacatgttcgcgcttgatcgcttctgccgcgtcgatggtcacttggtcatccgtggcgtcgcggttctcgattcccaggtcgtaatagtcgagatcgatgtcgagatacggcagtatgagacgatccttgatgtccttccagatgacgcgtgtcatctcgtcgccgtcgagctcaaccaccttgccttcgaccttgattttggccatgctgtgtcctccagtcgttgcgggtaacaaacccatgtgtaatgcaaaagtgttaccaacatgaatatttgtccattctgcaaacggtgcgggtgacgtgtcacatggcacggatagcctaaaggcatggctcaggaaacagaaatcggccttggcaagaaggcccgcatcgcttatggcttggacgacatatccatcgtcccctcccgtcgcacccgcgatccgcaggacgtgtctacctcgtggcaggtggatgcttatgaattcgacatcccggtgatcggggccccgatggattcggtgacgagcccacagacggccatagccatgggcaaacttggaactgttggcgtactcgatttggaaggtctgtggacccgatacgagaatcccgaaccgattctggagaagatcgcctcgttggatcccgacgatgccacggcgtatctgcaacaagcctatgcggagccaatcaagcccgaactcattgttgaacgactccacgagatccgcgatgcgggggtaaccgtggcaggtgccctttccccgcagcgcacgcagcagtactattcgactgtgctcaatgccggtgtggacctgttcgtgatccgcggcacttccgtgtcggcggagcatgtttcgaaggatcatgagcctttgaacctcaagcagttcatctacgacctcgacgtgccggtgatagtcggcggtgcggcaaactaccgggctgcattgcatctgatgcgtgctggggctgccggtgtgctggttgggttcggtggcgtcgcgacatccgccaaccgccagaccatcggggtgtccatcccgatggcgaccgccatctcagatgtggccgaggcgcgacgtgactacatggatgagtcggggggccgatacgtccaggtgattgcggatggcagcatgggcgaatcaggcagcttcgtcactgccctcgccatgggagccgatgcggccatgctcggtgcgccgctggcccgcgcccaagaggcgccggggcatggaacgcattggggttccgaggctcgccacgccacattgccgcgtggcctgcgctctgaggtcggtacggttggcaccctgcaagagattttgtatggtccgagccacaaggcggacggcaccacgaacttcataggtgcattgcgccgtgccatggcatcgtgtggctatgtggacatcaagagcttccaacgatgccccgtggtggtcaccgccaaccgatcctgaatgggaacatcaaagcgccgagtctgccatctcatcaggctcggcgctttggcattatcggggggaagggcgccgcggcgaggatgcgggaggaatgtgaataaatcatccacaaatccacaattccccgtgtcagggttgcgggataatcgtggcttcgatacattcgataccgaatacggcaaaggggaccgtatcggactcaagggggaaacatgcatacaccatccaacccatcgaatacgaaaccacatgcgggcaatgcgcgtcaacccatagacattcctccgctgaaggaagagctggagacatgccctcccgatgtggacatgcacatagaacgcacaccgttgccggtgcacagcggcatgctctcacgtaatcacagcctatgcccggtgcggttccgcatacgcagctgcgtcaatgtggaactgctgcccatcacggcatatggcataagcgaacgtgctttcaagatctgctgcatagcgtttgaggttgtgcgaggcagggtgggggtgcaggcgctgagaggcatggtcaccaccacctgctgcgagaggttagaactcatgcgggatcttatgaagtccgccaccagcagccgtgtcgatttgcattccaagcgtttctatgggcaacccatgcctgttctcatcgacggcaccgcggtgtctccgatgagattcgaaatcaccatcgaggtgagggtgggttccctccaatattgggtgaacatggtgctcgaccttcgcggcagtgcttggatatgcacctatctggatatgggatgaacttgacaccatccgatgaaatggcagacgattggatatagttgaaccatgctcagggaatatggactcgataacaaatacgtgaccacggatgacgacaccgtatatcagctgctgtcgaaacgtgctttggaacgccccgatgaactgattgcccagttcaaagaccctcagacgaaccaatgggtcgatgtcatggccggtgagatgctggcccaggtgcgcagcgttgcgaaaggcctgatggccataggggcgcgtccgggtaccatggtggcaatctattccgccaccagctacgagtggggggtcatggatttcgcatgtgccagcattggtgcggtgagtgttccgatctatgagaccgattcgcagaagcaggccgactcgatcatcacggaggtgcagcctgccatcgcattcggcggtgacgagaaccatacccatactttggaacgcatcgccgagcaggtcaaatgcctccgccacgtattcaacttcgagaacggtgcattggaagcgctcatcgattacggcgaatcggtgagcgaggacgagcttgatgcggccattggccgggtgcgtgccgatgacctgctcaccatcgtgttcacgtccggttccacaggtaagccgaaaggcgccatgctttcgcatcgcaacttcacccacattgtgaagaacggctacgagatcctgcccgagatgctgtacgatgccccgaaccgtctgctgctgtttctgccgctcgcccattgcttcgcgcgttacatccagtatgtggccatcggaggttatggggtggtgggctatgtgcccgacgccaagcatctgttggccgatctgcgtggcttcaagccgacgtacttgctcggtgtgccccgcgtattcgagaaggtttacaacgcagcttcccagaaggccggcgccggcattcgcgggcatatcttcgccaatgccgtcgaccatttcgtctcctggtcgaagatgatgtcggaacacaaacacccgggaccgatgatgcgaatcaagcattcgttctatatgagcaccgtggcctcgtccttccgatcggcccttggcccgaacctgcggtatctcgcgtgtggcggagcgccgatcaatccggacctcgtgcatttcttcaatggcatcgatgacatcaccttcattcaggggtacggcatgacggagacggccgctccgatgatcgtcaattggcagaaagccaaccgcgttggatccgtcggacgtcccggaccgggaatggccgtgcgtacggcggacgacggggagatcgaggtcaaaggccccaacgtgttccttggatactacaagaacccggagctgaccgatgaagtgctggagccaagcggttggctgcacaccggcgatctcgggtatatcgacgacgacggattcctgtacatcaccggtcgcaagaaggatctcatcatcaccgcgggtggaaagaacgtgagcccggccccgctggaaagcgcaatcagtgaatgcccgatcgtgtcccatgtggtggtcgtcggtgacaacaagccgttcattggcgcagtggtgaccctcgatgaggagatgacccgcagctggctcgataatcagggcatgcccacgaatctttcgatggacgatctggcccacagcgacggtgtccacgcattcatccagcagtacgtggacaaagcgaacgccaatgtatcccgtgcagagtcggtgcgcaagttcatcgtgcttccctccgatttcagcattgaggaaggcacgctcacgccaagccagaaagttgtgcgtcccaaggtgctctcgacatacagcgagctcatcgatgcggagctctatgctccgaagaatgcggcgcgtccggttccggtgagcatgcagatcatcgaaagcacctcggaaaccgtgaagaaagcctcccaagccgtgcagcacaccgccgagacggtcactccgaaggtccgtcaggcattcgacaatgtacaggaacgctttgaggagcttcagcagcatggtcggtccgatgaagcctcctcggccaagcctgagcatggtgcctcaaccacaacgaattcggattcctccgaacagaacacaaaggagcagtgacaagagtggcaattcgtgaaattcgggtcgttcccgatccggtactgcgcacgccatgcgatccaatcaccgagatcacgccggccgtacgcaatctcgtgcaggatctgctcgatactgtggatgacccaggccgagcgggcgtctccgccaaccagatcggcgtcagcctccgagccttctcgtacaacatcgatggcaagatcggctatgtgctcaacccggtgctcgaggagacccggggcgaacaatacggcgatgagggatgcctgagcctgccgaaactatggtacaagaccaagcgggcggattacgcgcgcgtgcgcggcatggatctggacggcaatgagattgtgctcgagggggacggcatcatgggccgtatgctccagcacgagaccgaccatctcgacggccatctctatatagaccggctggagaaggacgagcggcgtgcggcgatgcgccgcatgcgcagtcttgaatagcgctgactagccataccgaacgcagcgggaacgtctggtgtgaatgtccacagggggtcgcaattgaaatgcgaccccctgtggtattatcgagcattgtgcgccaaccggtgaagaaggcagtcgcagctttccgagccaaccgaatatcgtctaccggtgcacatgaattcgcgtcatgcccgcgacggcctgtgtcggtcggcagccctgtaggggcagctgcacgcaggatcgcatggccaggcaataaccgactaggaaggtagtaataccatggctcagatcactatgagcgaaatgctgaaggccggtctccaattcggtcaccagacccgccgttggaacccgaagatgaagcagtacatccttaccgagcgtaacggaatctacatcatcaacctgttcaagacgctggatctgatcgatgtcgcctacgacttcatcaagaccaccgtcgcccacaatggcaccgtgctgttcgtcggcaccaagaagcaggctcaggaagcgatcaagaacgctgccacccgcgtgaacatgccctatgtctccgaacgctggctcggcggcatgctcaccaacttccagaccgtttccaagcgcgtcaaccgtctcaaggaactcgagacgatggacttcgacgacgtgcacggctccggtctcaccaagaaggagctcctcctgctcaagcgcgagaaggacaagctggaacgtcagcttggcggcatccgcaacatgacccgcactccttccgcgatgttcgtcgtcgacatcaacaaggaagccctggccgttgaggaagcacacaagctgggtatcccggtggtcgccattgttgacaccaacgccgatccggaagccgtcgagtatccgattccggccaacgatgacgccatccgaggcatcgaactgctcaccaacctgttcgcggacgcggtcgccgagggcctgctggagcgctccggcaacgcctccaagagcgagagcaactccgagcagccgatggccgcttgggagaaggaactcctcgagaagaacgagaaggccaccctgcgtgaaaacgccgtggtcaccgaaaatgaggtgaagaagaccgacgaggaggagggagcctcctccgaagccgcacgtgccgacgcccagaacgaagaggctgtggccaagccaggcgaagaggtcgaatgatctctacggcgtcgggaagcttttgccttccgccgctgttgcattggtgggcgtaagccgcaaggttgcgcccaccacccatgcttttcacacaaacaaggagaaatcaatggcagcaatcactgcagctttgatcaagcaggttcgcgaggagaccggcgccggcatgatggacgtcaagaaggccctcaccgaggccgacggcgacgtcgcacgcgccaaggaaatcattcgcgccaagggcattcaggccgccggcaagcgtgaaggccgtaaggcccaggaaggtaccatcgcctccacagttatcgattccgcggcgggccagaccggctatgccgtcgagctcaactcggagaccgacttcgtggccaagaccccgaagttcatcgacttcgcagacaccgtgctcgcggacgccgtcaaggccggtgccgatgacatcgatgccgttctcgccgccccgtcacaggacggcactgtgaaggaagccgttgaagaagcttccgcgctcttcggcgaacatgtcaaggtcggtcagttcgccaagatcgaaggcccgaaggtcgagatctacgcgcacaagaagtccgttgagatgcccccgagcatcgtcgcgatgatcgccacggatgaggccggtgccgccgtggcccatgaggccgccctgcagatctctgccatgggcgcccagtggctcacccgcgacgatgttcccgaggacgtcgtcgagaccgagcggcgcgtcgccaccgagaagtcccttgccgaaggcaagccggagaagatcgtcccgaagatcgtcgagggtcgtctcaatgccttcttcaaggagaatgtgctgcttgagcaggcctatgtgaaggatccgtccaagacgatcggtgatctgttcaaggaagtcggcggtcaggctctcgctttcgctcgtctcgaggttggcaaggctcctgaggccgatgcctgatcttgactgatttcgcatacatatgaaaacgggggacgtggaattccacgtcccccgttttcatatgcctacggtgtctgcgtgcatggataccctgtagacaatagtgactgcgcgaaggcgcagcaaacggaaggcagaatatggcattggaaaacgacttggcacagccgcgccgagtattgctcaaactctccggtgaggcattcggcaatggcaaagtcggcgtggacactgcgaccatccgtcgcatcgccggtgaaatcgttcccgcagtggagcagggagttcaggtggccatcgtcactggcggcggcaatttcttccgcggcgccgaacttcaggaggcgggcatagaccgttcccgcggcgattacatggggatgctcggtacggtgatgaactgcctggcgctgcaggatttcctcgagcaggccggacaggcgacacgcgtgcagaccgccatcaccatgggccaggtcgctgaaccgtacattccgctcaaggccattcgccatttggagaaaggtcgtgtggtcatctttggtgccggcgcgggcatgccgtatttctccaccgacaccgtgtcgattcaacgttcgctggagatccattgcgatgaggtcctcatgggcaagaacggcgtggacggtgtgtacaccgccgatcctcgcaaggatccaagtgcccagcgtttcgaaacgttgagctataagcgcgcgctcattgacaatctggccgtcatggatgcctcggcaatggccatggcccgtgacaacaaccagaccattcgcgtcttcggcttggaaggtgaaggtaatgtgacccgcgcgctgatgggcgattccatcggtacactggtgtccaatggagattcctcgctggcgtagtcgccagcggtgacgaacacacgtagcagcaaaaactagaggagcatgcatatggcaaacgttgtagatcaatccaaggaacaaatgaagaagtcggtggagtccaccaaggagaactttgcaggcatccgcacaggccgagccaatcccgctctgctcaacggcatcgtggtggaatactatggcgctcccacccccctcaagcatgtggccaccattggtgtcccagagcctcgcacactttccgtcacaccatttgacccctcgcaggctaatgcagtggagaaggccctgcgcgactcagatctgggggcaagcccacgtcgcaacggatccgccattctgctgacgatgccggaactgacggaggaccgccgcaaggaatacgtcaaactcgccaagtcgaaggccgaggatggcaaggtcgccgtgcgtaacattcgccgcaagtccaaggaagccatcgacaaggccgtcaaggatggcgagatgggcgaggacgaaggcgatcgcctgctcaaggaactcgacaaggtgacgaaggccaccaccgatgagctcgatgcattgctggaggcaaagcagaaggagatcatggaggtctgatctccagatggtccaaaaggcaatggtgtgcatatccagcatgccattgcctttcatcttgagtggtcacgtcatgagtaaggcgtagggaaatggattcacaaatgcagcgcgacagggaagccaaggccgacgaggcaatcaacgcgatcaatagaaaagccggccgcaatatgccacaggcagtgggtacggcgatcgcgctcatcgccatcattctgctatgcctatgggcaagtcccatactgttcgtggtgctggtggtgctgttcatgatcgcggggctatgggaattgcgcgtggacttcgcgacgattaacctgcacattccgcttgtcacactatggatctgttccacggtcacattgctggcggtgtacttctacccacgccacgtcgtggccatggcggtctgtgttgccgtctcgctcatagccgtcgcattcagcgccactctgcaggtctggcatgggcgtcgtgtggagaaggagctcgataacaaggccctgaccacgccagatgcgcccgatcgtcgcaccgagcaacacagccacctgactcaggtggctgtcgcgatgttcaccgtgttgtacatcccactgctggcctcctgcatcgtgatgcccctgacgttcaacgagcattatttcgcccacgcgatgttgattgtgttcatgccggcgttgagcgacaccggtggcttgtttgcaggcatgctgttcggtaggcacaagctgagtccgcgcatctctccgaagaaatccgtggaggggctgtgcggatccatgctcttcgcggtggccggagcctatgccgtattcgcctgcacctatgagccggcgttgtgggccacgcgttggtgggcgccgttgttgaccggcgtgatcataggcattgtgggcacctatggtgatctgtgtgcgtcgatgctcaagcgtgatatgggcataaaagacatggggcatatgttgaaaggccatggaggggtgctcgatcgtgtggattcgatcctcatgtgcgcgccattcatatgcgtattgctgtgggcaactggactgtagacgaataaggattatgagcgatttcagagtgactgacgacaatcaggtttccgagaccgtcgagaccggcatcactgaaggtggccgcagtggcgcattccgtgacgtactcagcaagaaccacgcgcgccgcggcaaaccgccggttcatttcgccgatctgacggacgatgagcgcatcgccaaggcgaaggagctcggattgcccaaattccgggtccggcagctcgccaaccactactatgggcactttgacgccgatgctgggtatttcacagatttccccgcgggcaaacgcgatgaggtggcgcgtgaattcttcccgacgttgattcgcgaagtgacccggcaggtcgctgatgacgggcagacgatcaagactctgtgggagctgttcgatggttcgaagattgagtcggtgctcatgcgttacccgaaccgcaccacgttgtgcatctcgtcgcaggtgggttgcggcatgggatgccccttctgcgccaccggccaattggggttgacgcgaaacatgtccaccggcgagattctcgaacaggtgcgcatcgccgccgcaatgatggaacggggtgaagtggccggaggtcccggccgattgagcaatgtcgtgttcatgggcatgggggagccgatgggcaactatcgggcgattgtttccgcagtccgacagatcagcgcgatgcctccggaaggcttcgggatctctgcacgcaacatcaccgtatcgactgtgggcgtggttcctggcattcgcagactcgcacaggaaggcatgccggtgcggttggcggtctcgttgcacgcccccaacaacgcgctccgtgatgagttggtgccgatgaaccgtcgcttcaatgtggatgaagtgctcgatgccgcacatgactattatctggcgagcaaacgccgcgtgagcatcgaatacgcattgatgcggggcatcaacgatcaggagatccatgcgcgtcaactggcgaaccggctcaaccattacggtgacaactgggcccacgtcaacccgattcctctcaatcccattgaaggatcgaagtggacggcatcgaagcccgaggacgagcgccggttcctcgagattctgcacaatgccggcatcaccgccacattgcgtgacacccgtgggcaggacatcgatggtgcgtgcggccagcttgcggccaaaaccaacaacgcataatgggcatattctcggttcaggcggcaccaattcggtgtcgctttttcatgcccaacttgacataagcagtctgctcttgtaaggtaacatatgttacttaatagatcgaggagattgcattgccgcgtccaccacgattcacgcaggaggaggtcgccgtagccgcgtttgacattgttcgcggtgggggcgaggaatccctcactgcccgttccctcgccgagaagcttggatgctcggtcaagccgatcttcggcctgttcgacaccatggacgaggtgcggcaggccgtttgggaacaggcgaatgcgtggtacatcgagaggcttgatgcggcgatgagtgccggtgatcgaccgccatatctggccagcggtctcgcatacatcgagttcgcgcgcacggagccaaatctgttcacgttgctgttcatgcatcggcgcacacctgagcagatggaacaatccagcatccaactgcgtccggtgatcgaaatcatcgccaggcaattgggtgtggggtatgacgaagcctatgccttccatatgcgaatgtgggtgtatgtgcatggcatcgcctcaatgatcgtcaccggttatctcgactgggacgaggcattcgcggaacattccctttccgacatgttccatgcgctgagcgagtacacggaaacgaaacagggggagtgagatggacgccatatgaaccgtcgacctgaccaagaccttcggcagcctcaccgcagtcgacaagctcaatctcaccgtggcgcagggggagaccttcgcattgctcggcgtgaacggcgcgggcaagacgacgacgatctcaatgctatgcggattgaccaaaccgacgagcggcaacgcatacttgctgggagaatcggtactgaccgatgcgaagcgcatcaagccgcagatcaatctctcgccccaggaaacggccgtggcgccgaatctgagcgtcaccgagaatctcaggctcatcgccggaatctatgggcagtcagcgcagcaggccaaggcgagcacacagcaggcacttgatgaattcggactcaatgcggtggcctcccagaaagcacacacgctctccggtggcatgcaacgccggctcagcatcgcaatgggcctcatcaccaatccgaagattctgttcctcgacgagccgacggtgggactggatatattcgcccgtcgtgagctgtggaatgtgatcaaagggcttaaggggcgggtgacgatactgcttaccacgcattacctggaagaggtggaggcgctggccgaccgtatcgccatcatggtcgccggcaggaccatcgccatcggcaccgtggccgagctcaagaagcaaaccggtgaaaacaatctggaagacgcattcgtgaaactggtgggagggaacaatgagctggcataggacgtggttgttcgcgcgccgcaccatgaaggaaatcatgcgcgatccggtgaatctgttcttcggtctcgcgtttccggtgctcctgctgtgggcattgtcgttgatatacaagcaggtgggccagattccaggtgctgcgacaatctccggcgatgagctggccgcggccatctccgcctatgcgccggtgttcgtctcgttgttctccggcatgctgatcgccaaggatcgcacgtcgtcatttcttacacgcctgttcgcctcgccgatgaccgccgcggatttcactctcgggtattcgctgccaatgctcgtggtggcgctggcgcagtcgcttgtcacgttcctgttcgccgggctattcggccatccgatcggcgtgcgtatgttgcttggggcgattgtggttttgccgacggcgctcatgtacacggcgataggcttgctgtgcggcacgctgatgagcgacaaggccgtgggtggtgtgtgcggcgcgatgctcacgacaatcgcgttcattctcgccggagtcacggtgccgattcagatcatgggaccgacattccaggatattgcgaaggcattgccgttctacaatgccgcgcagtccgctgtagcggctgtgggcggcgactacgggagaatctggccgcatgtatggattgtgactgcgtatgccgtggggttctggcttgccgcggtcatcgtattcggtctgcgcaaacgcaatgtgaaccggtagttgccggtattcctgaggaatatatgcagggtcgcgatatcacaatatgggcgccccatagcaagcacatggcgatgtaacagggaatcggtactctagagcacggtatgcaagtcccaagatgaaacggagagcatgagcatgtcgttggcggtacgtgtgattccctgcctggatgtcgatgacggacgtgtggtcaagggcgttcatttcgaaaacctcagggatgccggggatccggtggagctcgcagcggagtattaccgtcagggggccgatgagctcacgttcctcgatgtgaccgcctcgagctcgcatcgtcagactatggttaacgtcgtcacgcgcaccgcggaacagattttcattccgctcacggtcggagggggcgtgcgcacgcccgaagatgtagattcgttgctgcgctgcggtgcggacaaggtgagcgtgaacaccgcggccattaacgatccgacgctgatcagccgcgttgccgagcgtttcggcaatcaggtgctggtgctgtcggtggatgcccggcgtgagcgtggggagcagcatacgcaatccggattcgaggtcacaacgatgggtggccgtaaatccaccggcatcgacgccctgtggtgggcgaggcgtgccgaggagctgggtgccggcgaggtgctgctcaattcgatggatgcggatggcacgcagcagggcttcgatctggagatgatccgtgcaatgcgcgaggtggtgtctattccgatcatcgcctccggaggcgcaggaaaggcacaggatttcccgcctgccatcgccgccggcgcggacgccgtacttgccgcatcaatcttccactacggcaaggttacaatcggcgaggtcaaggacgagttgcgccgtgctggctatgccgtgcgctagagaggccgaagggatgccctggatgctccccggccaccaattgaatgaacgcctacagcattggagcaggcatgagttatgaatctgaaatcgtatacgacaacaccaagacgctggatccgcgtatcaaggaccgtctcaaatacgacgacaaggggctggtctgcgccgtcatccagcaatacgatacccatgaggtgctcatggtggggtacatggacgatgaggcattgcgtcgaacccttaccactggtcgagtcacgttctggtcgcgatcgcggcaggaatactggtgcaaaggagacacgtccggtcatgtgcagtatgtgaagggtctcagcctggattgcgacggcgacgccattctcgtggaagttgatcaggtgggtgctgcatgccacaccggcaagcgcagctgcttcgacgagggtgggccgttgccggtggtcatgggcgagcgcgaacctcgggaggagacagagtgagcatgcaggactccagtagtgtgaagaatctgggttggggggaaacctggccgtcgcgcgagcggttccatgaacttgccggtgaagggtaccgcatcatccccatcgtacgcaggatccttgccgattcgttgacccccgtggggttatatgaacgtcttgcagggcaccggtcggggaccttcattctcgaatccgccgagactaatggcacctggagtcagtacagcttcatcggcgtcaattccatggcccagttacgttcgaatcaaggcgaggccgattggctgggaaaggttcctgtcggtgttcctctcaccggagacgtcatcgatgtggcgcgtgcgacactcgatgtgcttagatcgccgaaagtggagggcctgccgaatctgaccagtgggctggtgggcaatgtcggatgggatgccattcggcattgggaaccgacgttgcctgcgaatgcgcccgatgagaccgagcagcccgagctcacgttggctttggccaccgacattgccgtggtggaccacaagacgggatccgtgtggctcatcgcaaacgccgtgaacgtggacgacaagccgacccgtgccgatgccgcttacaacgaagcggttgcgcgcgtcgggcagatggagatccaggccgcgactccggcgcaggacgaattccgcgtcaacgtcgtagacacatccattccccaaccgcagctgcgcttccggacggcgaaggaagatttcatcgcgatggtcgaacgatcacgccggcacatcatcgacggagacgtgttccaggtggtggggtcgcagcgtctcgacatcgattcgccggccgatcccttcgacgtctaccgtgtgctgcgcacgctgaacccgagtccatacatgtacttcatgacgctcaccgatgcgaagggccgcgttttcaacgtgatcggatcttctccggagacactcatcaaagtcgacaacggattggcgatgagtttcccgattgcggggtcacgcccgcgaggcaagaccccggaggaggacgaacgtctccatgacgagttgcttgcggatccgaaggagcgcagtgagcacatcatgctcgtcgatcttgcccgcaacgatctgagtcgtgtctgcgagccggactcggtggaggtggtttccctgatggatgtgttgcgctacagccacatcatgcacatctgttccaccgtcaccggacgtgtgctgccgggactttccgtgatggacgtgttcacatcggcattcccggcaggtacgttgtcgggcgcgccgaagcccaaggccatcgaactcatcgatcagatggaaccagcggatcgcggcatatacgggggtactgtcggttatttcgatttctccggcaatatggacatggccattgcaatccgcactgcgttcattcgcgatcacaaggcgagtgtgcaggcgggagccggtctggtgctcgactccattccggagaacgaatggatggagacgcgcaacaaagcgagtgcgagcgtcgaggcgatcaaaatcgcggcacaactcaaacaggtgtgagcgcccgcatatcgaagtcccccgtattcgtcgtcacaacgaatacgggggacttacgtcattagaatcgagtgatttctcacttgccaaggatggcgtgcacatgctcgcgcagtgccggcaccaccgtctcatcgaaccacggatgctcggtgcgccagatgtcggtccggcccgacggatgcacgatggggaagtacttgggcaggtattcctggaagtgcttcaccgtgtcctcaagacgcgccttcgaccattgattgaggtagtacttcacggcattcgatccggccagaatcgtcaacttgacatccggcagcagcttcatgatctctgggtggtaggttggggcgacccactcgcgcggctcctccatgcccttgtctccaggcacgtcgccaagatagtagaagtccattggcacgagtgcgaattttccggaatcgtagaacgtctctttgtccacatcgagccatttgcgcagggtgtcaccgctgcggtcgttccagcacaagccgcgcgtctgcgcgtccagactcggtgattgcccgactatcgtgatgagcgcggtggacggcgccgagaaaaccggcttctcaccgcgcttcgtgaactccgcgtcacgcgggtcgtccatgatctgcttggttatcgattcaatcgtatccatatacactccttagcatgtctccaccagaccggcttagcacgttctgggcaaaccggcgcggaaacgtggcccgcttctgccaacggcgtcatgcggaacgctctgcggttcaaaaggaaaaggcgtgaacctgaggttcacgcctttcattggattcgaagcggtctggtgacgcgatgtcacttggactggtcctcgtgatccttcttgagttcgtcgagcttggcctcggccttgcccttgagctcgccggccttcatcttgacctcgtctgccttgacttcggccttgcccttgagttcacctatcttttgagccatatcactcatgattggctcctttcgtttgtgtgtgcctgtatggcactccatccattacagcatgttcggcaaattaccaaacggattgttcgtcgagagcaatgggggattcgtgcacggtgtgggccccggacatacctgctatgggggtccagtggagtatgaaaaagggacatgcatgcacgtccctttcagccggaaaatgtggagcggaatcagccgagctgggttccgaagcgctcgttgagctccacctgatcctcggtggccttggcttccttggcggctgccttgccttcggccttgtccttcttgtcatcggccttgtcggtgatcttctcgagcttggcatccgggtcgtcagcggccttgacgatcttctcgtcctccttggcaatcaccttggcagcatggtcctcggcacgctcggcgcgcttttcgtcacgctccgccttgtgctcctcgtgcttctcctccatgcgatccttgaattcctcgaaatgttccttgatgtctgccataatcggttcctttcatcagtgatgtaggctatgtctaattagaccaccatttgcgaatgcatagatggcattccgcttttgagcgtaattccctcgccgtgtgtgattcggtgttatgcgtcgagccgtatgtcgccggcgagaaggaacagaccacgattcagacgtcgacatgcgttcgtcacctgcattccgttacagtgactatgacgggaagggcccgttgagccatcgcatcccaaggaggagcatgtcggttttggatgaactggtagcgggggcactcgaagacaagtgcgaccgtgaacgcgtaacgtcgttggaagagctcaaggcccgggctgcctcggctccggctcccctcgacgcgaaacgatggcttaggcgtcacgacggcattccggtgattgccgaaataaagcgtgcctcgccgtcgaaagggcatctcatcgatatagaagaccctgccgctttgggccgacaatacgaacaaggcggtgcgagcgcaatctcggtgctcactgaaggccgcaggttcctcgggtctcttgacgatgtcgatgccgtacgtgccgctgtgcacatcccggtgcttcggaaggatttcatcaccacggattaccagatctgggaggcgcgtgcgcatggggcggacatcgtgctgctcatcgtcgcggcgcttgacgacacccagctggcgcatctgctgaagctcacgcatgaactcggtatgaccgccttggtcgaaacgcatacccgtgaggaaatcgagcgggccatcgcggccggcgcgcgtgtgatcggcatcaatgcgcgcaatctgaaggatttgcgcgtcgatgtgggcaaatacaccgagttggcgagcaatctgcccgaagatgtgatcaaggtggccgagtccggtgtattcggtgccgttgaagttgaggattatgcccgcgccggagccgacgctgttctggtgggagagggcgtggccaccgccgatgacccgcggctggccgtggaacgattagtgaaggcaggagaacgagtgaaagcttctgaaaccactccgttgagcgaacatcatggcccgtattgggggcagttcggcggtcgctatgtgccggaggcgcttatcaccgccctcgatgaattgcagcgtgtgtacgacgacgcgaaagatgatcccgaattccacaaggagctcgccacgctcaataagcgctatgtgggacgtccttcaccgctcaccgaggcgccgcgattcgccgaacgcatcaaggaacgcaccggactcgacgccagagtgttcctcaagcgtgaggacctcaaccataccggtgcccataagatcaataatgcgatcgggcaggcactgctcgtcaagcgcatgggcaagacccgcgtgatcgcggagaccggagcaggacagcacggcgttgccacggccaccgtgtgtgcgatgctcggtctcaagtgccgcatctacatgggacagatcgacgcacggcgacaggcgctcaacgtggcccgcatgcgcatgctgggcgccgaggtggtcgaagtgacacttggtgaccgtattctcaaggacgccatcaacgaggcgctgcgtgattgggtcaccaacgtcaaagacacccactatctgcttggtaccgtcgcaggtccccatccgttcccggagatggtgcgtgactttcagaagatcataggtgaggaggcgaaggagcagctggcacagtggtacggcatcgatcatcccgatgcgatctgcgcctgcgtgggcggcggttccaatgccatcggcatcatgaacgccttcctcgacgatccgcgcgtcaacctctatggtttcgaggctggcggccacggtccggactccggccagcatgccatccgtttcgcaccgggaaccggtgaactcggcatgttccagggggccaaaagctatctgcttgggaactctgagggacagacccttgacacctactcgatttccgcaggccttgattatgcgtccgttggcccagaacacgcatggctcaaggaaatcggacgtgtgaactattcatgggcgaccgatgaggaagcgatgaacgcgttcaaggatctgtgcgagaccgagggcatcattccagccatcgagagctcccatgccgtcgccggcgcctataaagcggcacgggatctcaaggagaagggctatgagcatccggtgatgattgtgaacatctcgggacgcggcgacaaggacatgaacaccgccggcaagtggttcggatatctcaccgatgagcaggcagccgcactcgaggcgaacggtgcgaccggcaacaacgcgtgaacgagtaagtggaataggagcagatatgaccgaatacaacaccacgccaagcggtcagccgcttggaatcagccatcgtcccagcccatgccgcgagctgttcacacggttcaaagcgcaggacaagcctgcattcattgggtacctgccattcggattccccacgatggaacagtcactcgaggccttcgccacgatggtcgagaacggtgctgacattgtcgagataggactgccgtattccgatccggtgatggatggcccggtgatccaggccgccagccagatcgccctgaacaatggcgagcgcatagccgatgtgttcaaggccgtggagacggtggccaatgccggtggagtgccgctcatcatgagctactggaacctcatctaccattatggggttgaacgcttcgccgctgatttcgcgaatgcaggaggcgcaggccttatcactcccgatctcattcccgacgaggcaggggagtggatcgaggcgtcggaccgccatgggctcgatcgcatcttccttgtttcccccgactccaccgatgagcgtctgcgggtggtgtgtgaaaacgcccggggattcgtctatgcggcatcgcgcatgggcgtgactggcgaacggtcgagtctagggacttccccggaggatcttgtggcccggacccgtaaggccggggccgagaatgtgtgtgtgggcatcggcgtctccaccgctgctcaaggcaaggccgtcgggcagtatgcagacggggtcatcgttggatccgccttggtccacaccctgctcaccgaggatggcgatgcgcgcgagctcacctcaggtctggctgcgttggcggccaagaccgcagaactcgccgagggcatccacaacgcacgcctgtagcggcacgctattggttggcggccgggacaatgaatccggctgccaaccaataccggtcctatgccgatatcggttctccacgctatattcgagcgtatgacgactcttgcctacattccctcgccatccatctcccaattccatgtgggatcgctgacgattcacatctatgcgttgacgatgctgctgggcatcattgccgcggtatggatcaccggcgaacgttggaagagattgggaggcactttcgaccagatcttcgacaccaccctggtggcggtgccatgtggcatcgtcggtgcacgcctctaccacatcatcaccactccggaacgtttcttcggcccgaatggcgactgggtcgagatgttccgcatatggaacggcggtctcggcatctggggcgccatcctatgcggcgcactgggtgcatgggcatggtgtcgccataagcattatccgatggcattgctggcggattccattgcgcctgcgctgcttgtcgcccaggcgatcggtcgccttggcaactggttcaaccaggagctgtacggcaagcccaccacgctgccatgggggctcaagctcaacatgaacggcagtgccataggcaacagtgagacctgctatgacggtgcgagctgcccgaccggcacgctgttccatccgaccttcctgtacgagatgatatggaatctcatcggagccgccctgatcatctggatcggccaccgacttgcgaacaggctcaaggccggatccctgttcgcgctgtatgtgatgtggtacacccttgggcgcacctggatcgagatgctgcgcatcgacttctcccacgagattctcggactgcgcgtcaacgtatgggtgtcgatcattgtgttcatgctcggagccgtcgccttcatcgtcatccagcgagtgggaagtcccacccagcttctcagcgacaagctgcatgcccagaccgaattggaagccagacgggagcagtcgccgcaggatgcaggtggctccggccgcaatgcgggctgaatatggccgctcagacgtctcacctggtcgattactgtatttagaatggcaaccatggatattaaaatcgcaccaagcattctgtccgcggatttctgcaatctcgaacgcgacctcgagcgcatttcgaatgcggacatggttcatgtcgatgtgatggaccaccactttgtcccgaatctgaccattggcgaaccggttgtcaagcgcatctgcgaggtcaccgatctgccggtcgatgtgcatctcatgattgacgatccggaccgctgggctcccggctatgcggagcgtggcgcccattcggtcaccttccacatgggggccacccatgcgccggtgcgtctggcacgccaactgcacgacatgggatgcgaggcatggttcgccgtacgtcccgccgagccggtcgaaccgatcttcgacattctcgaggaattcgacaccattctcatcatgacggtggaaccgggattcggtggccagaagttcctcgccaaccagatgggcaaggtgcgccgcctgcgtgacgaaatcacacgtcgtggccttgacacgaacattcaggtcgatggtggcgtgagtccgaagacggcggcaaccgtggcccaggccggcgcgaatattctcgtcgctggatccgcggtctatggcgccgctgatccagccaaggcgatcaacgagattcgcgacacggccgccgccgcctaccgcgactgattcgcaacttgccgcacgtcgaaacggcgtgcggcacattcatgcccataccacgtgccacactgggtagcacgtgtacgttcgattaaggaaaccatgaagacattcgagtcgctgttcgccgaactcagcgaaaaggccgccaaccagaccccaggttcactcaccgtggacgaacttggcaaaggcacccatttcattggcaagaagatcatcgaagaggcgggcgagacctggatcgccgccgaatacgagggtgccgagcgcaccgccgaggagatgagccagctcatctaccatctgcaggtcatgatgatcgaccgtggcatcactctcgacgacatctacaagaacctgtaagcaaatacccgccggggcgccggtcgcatgcggcgcaagcgtggggaggaagttggaggaatcatgctgagaatcgcagtgccaaacaagggcatgctttccgagccggcatgggccatgctgtctgaggccggatacacgttgcggagcaacccacgccaactggtggtggaggaccccgacaacgacgtcgaactgttctaccttcgtccactggacatcgcagtgtacgtgggcatgggcaccatcgatgtgggtatcaccggccatgatctgctgctcaactcgggaactgatgcgcaggaggagatgaacctcggtttcggaggatccacgttccgtttcgccgctccgcaggacagcccgatcaccacgctcgacgacgtcgaaggcaagcgggtgggtacctccttcgacaagcttgtgcatgactatctgaccgaacacggcatcaatgcgacgcccatacatttggatggcgcggtggaatcctcggtgcagcttggtgtggctgatttgattgcagatgtcgtttccacaggtaccaccctgcgcaacgccggtctgcgcattttcggggaaccgattctgcactcggaagcggtgctcattcgctcgccgcggttggacccccaggacgagcgcttggaacggctcgaacgccgcctgcatggtgtgctcacggccaagcgctatgtgctcatggacttcgatattcccgtggagaagatctctgcggccgtacagatcacgcccggcttcgaaagccccaccatctcgccgcttcatgacaagcagtgggcagcggtgcgcgtcatggtgccgaaagccaaggtgaatcagctcatggatcagttgtatgaagtcggcgcacgcggcatcatcgtcaccgccatccaggcgacgcgaatgtgagtcgcttggatgtgacgcccatggatctcaaagagaagttcagccggaagaagtacagtccggaaccgcgtgacgtggtgttcaccataccaaacatcatcagtctgttgcgcatcatctccattccgatcatcgcatggctcatcaccgagcacagcatggtatgggctctggtcgtgctggcgttgtcgttcgcctctgatgggctcgatggtctcattgcgcgtaaattcaatcaggtgagcaagatcggccagttgctcgatccaatcgccgaccgattgctcatcctgtgctccattctggcactcggcatctgccatgtggtgccttggtggatgctcattctcgtggctttgcgcgatgtgacaatggccgtgctcaccgtggttctcgcgcaacataactatgggccgctcccagtgcacttcgtaggcaagacaggcaccgcagtgctcatgatctcgatcgtcggcctcatggtggccgatatagaacgtcagatgcccgtgttcgaaatgctgcactatgcggctatctcctgtgcgatttggggcataggactgtactggatggccggaatcctgtatatgcgtcagggtatcgggctcctacaggcggatggacgtcaaaaagcagtcaggtaggtaaatcagagagaggacgcgcagttgacccgcgaaaacggcatgcctgaagtgttcccggtgagcgttgaagatccgccggttcgcaggcgtgccgttttttcgtccgcatacgcccgtctcgactcacatcacaccgagatatcacgtggtggggtgatgccgcctcggcgccggggcaaacactacgatgcctcgcttcggctcatcgacgatctagtgaaccgtccgatggacgccctctacaacgattcgagactggttaccaaaccggattcgaaactcacattctggggcacgcgcattatcgtgctcatcatatgcgtggccgtcggattcgcgggatgcctgttcgtgcgcctgctcaacaccgatccccgcaaacaggtgcgtcaacagttggcgtcacagcttgaggcgcagaatactcatatcgacgaactggagaagcagattgcggatatgcgcgcagatgtggaccgccaatcgcaatccgcattgccctcccaagtggagcaggaggtgcggcgcaacgaagcggctgccggcgccaccgctgtcgaaggcgagggcattgtgctcaccgttgccgacccgatggtgacgaacagcaatgcgcaggaaggatcgttacctcgagagaaatcgacgaaccgattgcgcgtggtcaccgacaccgatctgcaattgctcgtctcgcttatgtggaaggcaggcgccgaggcgatctccatcaacgacaacaggcttggggtgcagacgtccatacgaaccgcaggcaactccatactcattggcaccacaccggtttcaagtccataccgcattcaagccataggcaataagaacgagcttgcgaatagaatggggcaaaaggagctctcgacactgtaccaggagttcaaggacgccggtatgacgttgcagaccagcaaggagaatatgattcgactcaaggcggcaacacccggtcaggtttcaaatgcgaaggagatacggtaatggcagcagtgctcggtctgatcatcggcgttgtagtcggtctgttcgtgaaaccagacattccgatttggctccaaccgtatcttccgatcatggtggtggcggcacttgatgcgttgcttggcgcggcacgtgcctacttcgagcgcagcttctccgacaaggtgttcgtgatctcgttcttctccaatgtcgtcaccgcaacactcctggtgctcctgggcaaccaacttggtgtggggtcgcaactctccaccgctgtcatcgtcgtgcttggcatccgcatcttctccaacgtctcggcaatccgccgtttcatcttccaggggtgagtatgggcgaagcgaatgggcacgagaacaaaccgattcagtcagccgggacgcctcctgaaccacccagcggcatccatgtgaagaaaatcctctctcagcagaaaaaagaccggcagaatgacaaactgccaaccggtgcatttccggcggtcaggaaagcgaaaccgaagaagcagatttccggacgcgcacaatccattcgcgcgcggctgctggccagtgtacttgtagcggcattgtgcgcactgctgtcgttcgggtacgtgatccaggtgaacaatacggatatgacgtatgagacgatgaccgagtctgaactcacccgtatgctcggcgagacgaacacgcaggtgcagcgccttgaagagcgacgcaccgagctcagccggcagctcacttcactgcaacaggcagccgataaggaggccgaggcgaaccgcatcgccaaggagaacgaggagtccagcggcattctctcaggtcggcttcccgcggagggtcccggtatcatcgtgcatatctccgccggcaccaaggcgccgatcgatgcggcgaccatgttcaacctcatcgaggagctgcgcaacggaggtgcagaggtcattgccatcaacgatgtgcgggtggtcacctccacctacatcagcgaaggtgcgaatggcctcatatgtgacggcaaggcactcaacgcgccatacatcgtcaaggccataggggagcagaacaaccttgcgaatgcggtgaacatggccggtggcgtcggctcgaggcttacggtgaaattcggggcgagtgtgaacgtcgagacgtccgatgacgtgaaaatcacccaaacgcagccggtgaccaactataagtacgcaaagattgtagaatgaggagttatgactgatccaattccaagtgcaggcgaaaccaccatcatcggcatgcctgccatccagattccagtgaccaccagcggtgagcgtccgttgacgcaggaggatctgcagaccatctccagactggcggacgacacggctctgcttatcgcaacacgtggcgctctttccggttcgcgttacctgctcgatgaagacgaggtgaccgtaggcagggacccgcgcgccgacattctgctcgacgattccacggtctcgcgccagcatgccgtgttccgccgcgaaaacggcgcttacacggtgattgatgccggcagcctcaacggcacctatgtgaaccggcagagggtcgacaaggcgacgctcaagaatggcgatgagatcatgattggcaagttccgcctgatctatttcacgaacagcgcggtgcgtaacatctgagcattgagccgcacgccctgcaatggagtcgaatcgggagacacaagcacagcgggaaggtcggaatgacggcctcccgcttttcgtggatgtcccattgctcgatgtcgacgattccatggtgcaaggggagttgtttccggactccctgctggaaaccgagcaggttcgcatggggtatcgcggatctgcggcgtcacgggcggccggcatcacataccggcaactcgactactgggcgcataagcatatcgtggagccatcggtcaccgcatcgcacggttcggggtcgcgacgcctgtattccttcaacgacgtactcatgctcgccgcatgcaagaaattgctcgaccttggcgtgaacttgcagaacatatcgcaaacattgcagttcctgcgggcctaccgctccacgcagctctcccacatggtcatcgtctgcgacggggagcatgtgcgcgcctgtgagggtgagaccatgttcgccgatgtcctgcagcatgaatccgccgtgttcatcattgccgtcggggcgttgttccgtcaggtggagtccagtctggcggccgccgaatccgttgctgtcacctccgatgtcgccttgcggcacctgagcgtcgattccgatggaccgttggctcgtctgccgattgtcgcgaaaggcaccagactgcatcaccgggacgcgcacgtcgagcctccgtatcgcgatgtgcccttggacatcgatgggcattcgtacgccgtggcgtaatatatcaatgtgcatgaagacgaggggagtgatatgaacgccttacctgccattctatggattgcagcagcgctctgtgcagtcatggtgtgtgcggtcaccgtgcactgcagccatttcgggcgcgcggatgttgtggtcaaaccagtcagttgggccgtgatcatcggccagctcaccacctttgtcttgttcgccatgccgtatttcctgttcctggcgaacaaggactcgatcggcacccacccacgctcgctctacgaacggttgggatggccctccgcggtggttgccgtggtgttggtgttcgcggagttggcgctcatgtatgtgcaggctcggcgtgccatgcgtttcgaaccggcgcacgtcgaaccattgcctgacgatggtgacgcagacggtgatgagacccatgaggggatgtcaatcatatgatctggccgaatctaagtgcggtggctgttggcgcattcgccggcggctgtttgcgctcattggcctcaggctggcttaaccgcaaggactacgcaatcccatgcggcaccctgttggtaaatctggccggttcgttgctcgtgggcatcatgctgggggtagtggccatggggtctgtggccgagccatggaaagctttgctgatcacgggattctgcggcggtctgaccacgttctccacctttacgtcggaagtcgtgtcgctgttcgaagagcacagtacggttcgcgcgtggatctattggattggcagcgtcgtggcaggcatttgttgcgtggcgtttggttttcttgtcaccagagcgtttgcgtaggggtgaggattatggaactcattgcagtgggattcggatgcgcattgggagccgtctgccggtatctgctggagaatggcttcaacaattggacgatggatccgatctcgattcttgtcatcaattgcgtgggctgtttcctcatggggctattcaccgcaatcatcgaacgacgcgaaccgagcaaggccatggcgaaattcatgaccacgggattctgcggcggtctgaccacgttctccactttttcggccgatacctacaaactgctgcagacgaatgcctggcaggcgattgcgctagtgctggcgagcctgttcctcggcatgctgctgtacgctctgggtcacaggcttccgcggcggaatgcacacgccgatgttgtttgagttgcggaggaatccaaggcaatgcatggaggagaaggcgttgctgttccggtaaaccttgttaaatgccacgttggttcgaataatgaagtaacaggcacttaaatcatcgaagaaaacacaaaattactacacgtttaaatatatctatacatcgtgctgtagaaaatccgtaaaaacagatctacagataagtatattgaaaagtatcatgcaagtgttttcaataataagacttgttcgacgagaatattttcccgtgacccattgttttgtcgtggcgtgattggtcgtattcgttgatcttatcgtgatgaatgtcgcggtatcggtgccgccgctggtgcggagggtgtggccgcgtattcatcaatctgactgagcctggcgaacgagctagatatgacataccgcatatatatcactggggagtgtgacggatatctaatctgacataacgtacattatcggataatggtataccgatatagtgaaggggcgtatacgtattgcatgcgccccttctgatgagattattggattgtcaatcggtcactggcgttccgtgaagtaatcgttcaccgcatcggcaagctcgctgacgaacggaaccacacggtatgcgccatgctcgcgcaattcgttcggctcggcatagccccagccgcaacccaggcagtcgagcccattgagcttggcgccgtccacatcggtccaacgatctcccaccatgagcgctctgtctccggcgttcctgtccacaccgattctgtcgagcgcataggtgatcaccgcttccttggtgatgcgcgaattgtctttgcttgccccgtagatgccgtcgacaagatcggtcagatggaaatgctcgcaaatcggaatggcctgatactcgggctttgccgtgcataccgcgagatagtagcccatctcgcgcattttgcgcagctgttcgggaatgccttcgtacatcgagttgacaagacggccgggcactttccgcccgggttcgttcggatcgttgaacacattcgcatcaccatagaaatgccgatagacgcgtaccgcctcatcgagtttctgcggcggaatgccgttgagcttcatcgaatcgatgatggcaggtccaatgaaacgctgcaatgcctcgtcgtttggcacgggaacatccacggcctcgaaggccttgatcacgcatttgatgatgccggggcccgattccgtcaacgtgccgtcgagatcgagcaacaccactcgcctgggttctgtcatgtatttcctctttccgtcctatatgggcacacgctgttttgcaaatgaaaaacctgacataacatgctctgtcatgtcaggttgtcgtcactcgtagtccggaatccagccgtcgtgatgcatcttcagacgcttttcgagcaatgccgccagctcgtcctcgctacgacgctccatgagcatatcccaatgcgtgcgggtcggcttggtgatttcgtccggctgctcgtcctcctcgttctcacggtgcgcggtggcgccgcaacggcactcccattcgttcggaagatccgcggactcggcgaacggcaggatggtgcggtgccccttcggacatacgtaggccacttcgacgcgagccgcgaaatcgacgttgtcgtcggactccaaggactttgcgccgatgctcatgccgcgcagactgcgttccgccatgctgttcctccttgaggtttcaaagtacttccaagctacaaaacagctgggactacccctttattccttgcattctcggtgtctggcaccggttttggcgccgatcagtccacgccggagtaagccacgatgccacgattgacgcgctcgtaggcctcatgcgcgagggcggcgagctcggcaccgccctcccccagatatggttcggcgacggcgatctgctgcaatacgtcggcaatgcgtttcgccgtacgtacgaaatccccaccggtcatgtcgctgtgctcgagcacttcggagagcgagtcgccatatgcccagttgtacatgagatcgacgattccaaagtccagcggttgcagatagttctccagaccgttcgcctcgcacaatgcgatgatctgcccatccatgtccctcaaggcgttcgcggcctgcatcacacgaccacgggggcctcccgggtaccttctcggttccccaccctcgcctcggcgaggttcgtacagcaacgacgacatcactgcagcgagttcgggggcattgagatcgtcgaagatgccatgggtgatcgcctgcgccaataccagatcacgttcggtgtagagtcgcctgagtagctgcccgtattcggtgagcctgtagtcgatgtgaccgttctcgtcggctgtctcaaggtaaccgagcacttcgaggctatggcatatgcggtcgaactgacgagccaccgaactggtacgggattcatagcggtattccagacgctcgagttccttggtctcacgcacccagcggtgcccccatttcatcagggtcttgaaatccgcagaccgtttggcggggtggttcgcctcctgctctttgagctgggcgatctgtgcatccagccggcggaatgcacgcgaacgctcctcattcgacttgaacacctcgtgcttgagccgccggcgttcgttcttctgcaggtcgctgagcttcatgcgaatgcgcagcagctccaccatgtcaccggcatcattgcccatggcctcctcatagccagctatggccttgcgcagtttgtcaatgcgtgcctcgagatcccatgccgactcattggcttcccattgggcgaacgaatggtcgagggtgtctcgtgccgtctcataatcgctggagttgagtagattgacggccatattgaaggtcgccttgaagctcgaatgcagcgggtagacgcgcttgctggacaatgccactgccgtctcgggtttgaaatcgcggtgatcgaccacgatggcattgcctatggtgtcgatgccccggcgtccggcacggccggtgagctgggtgtactcccccggggtcaatggaacgatgccagtgccattgtatttctccagcttctccaccacgacgctgcgtgccggcatgttgatgccgagcgccagtgtctcggtggcaaacacacacttgatgagcccctcttcgaacaggcgctcgacaatctgcttgaacagcgcgatcataccggcatggtgcgcggcaaagccctcttccaaggcatagcggaactgtgagaagtgcagggtcttcaggtcctcacgagtgagctgtccctcaatcatctcatccacgatcttgcggatgtgcagagcctcctcgtcagtggtgagccgcaacccggcgttgaggcactgttccactgcctcgtcacagccattgcgtgagaacacgaaatatatggcggggagcatgcccaagaagttcagttcatcgacgaccgcccaacggcgaggctgatatcgttccggcttgcgcacgaacttgcgtttgcctccgcggtcttgccgccgctccgacctaccatgggtgtccgcacgcgcgcgccgcgcctccatacggtcgagctcgtcaagccggttcatcagccgtgcattcattttgacggtctgttcgcccatgtcgtccctgcaatacaggtcgaacaactccggttcggtgcgtggatccttttgcaataacacgtactggtccagcggaaccggccggtgttcagacaccacgagcttggtgtccccgcgtacggattcaatccagtctgcaaagtcctcgacattcgacacagtggcggagagtccgatgatccgaacgctctgaggcaggtggatgatcacttcctcccaaatcggtcctctgaacctgtcagcgagataatggacctcgtcgagaatcacatagcccaaggcgttgagcgttgtcgaatgctcgtagagcatattgcgcagcacttcggtggtcatcaccacgatgtcggcctcggaatttatcgaggtgtcaccggtgagcaaccccaccttatccgcaccgtacatgtcgactagatcatggtatttctggttgctcagcgccttgataggcgtcgtgtagaacgccttcacattgcgttgctgagccagatatatggcgaaatccgccaccacggttttcccggcgccggtcggtgccgccacaagcacattggagccggcctcaagagcctcgttggcatcttgctgaaaggcatccaactcgaatggcatacggtccgcgaaccgtgccgctacagactgcatgcgcttcctcgactccttgaaggcccggtaccgttcggccgggctgagttcacgctcgtctgttgactcggaatgcctgttccttttgtttcgtcctgccattttccccatccacgtcagtcgttgaatgaggcccacctgctccagattcgtgcatagcgttcacgacgtgcccgcttgcgtttgtccaccttcgtatgggcctgcgtgtatcgattggcggccacctcgagtggctcggtgaagatgggacgctccttggggtgtcgggtgccctcggtatcggacatgagggcaatccgttcagagaccgcctcaccggtccgttgcaccgactggagcgcatggagtccgtgaatgatcacgtagatgatgccggcaatcagcaccgccagcatggcaagggccagaatcaaccagatccaccacggcatgcattacctctttccttgcgtcgtcctgtcaattccaccgggcgcgatggcgtccgtccgtcatgtaatatacctctacacgcaccgcatcagcgggcatgatgttcctcggctgaatcggcctcgccgttctcgtcgagcatgctcagctcacgcttggcgcgtgcgataatcatcgtgcgcaaggtctccggtgccactgccagaatatggcgggcatgagcaatgcagaacgccacgaaccacgagtcagactgaatctgcagtcgaaccttctccccctcaccgcacggttccacctcggcatcgccgagtgtgcgtatgaactccaaatgcggttgatcggtgatgaaggcggcggatgtggaggtctcgatgctccatttgcgcaggtcgctcacagagacatctggaatctgcatcggcttggtcggttccacctcctggacctcctctatgcgcgcgatgcgcaggatctgccagattcgaggttctccggtctccttgttaatcgtcatgtccttatgcacgattttgtgcagcgccgccggggcgacgtcttcgacatcggtccacaaggccacgtaatacacgccttcgtccacgtagattttggatggtgccaccagacgctcgcgaatacggccagaaccatcggtgtacttcatgtccagcaacgcatgctcagcgattgccttcttcacaatgccgaaggaacgcggttccacctcgtagccggtcagactcagccaaggggtctgacccggttccacatactggcgcaggcggtcatagaggtcaaccgcttggctgcgttcctcggcgggcagcagcggtgcatgggccagatagttcaccgatgcggtgagcatgctcatgtattgcggcgagattccggcaagacgttcgaggccgagggagttcgtggcgcatacaatgccctcggcctcgagcaacgaccagtcgatgtcgaagaactggctgccagccatctcgccatcgtcggagacggtggtcagtgtgttgatgtccttgtgaattgtctgtacgaacttcttgcgctcgtcgtcattcttggggacgccaatgaagcgcacggcgagttcggagagcgagtattcctctcccatgtgggcggagaggaacagcatgaggcgcagacggcgatccacttcgcttcccgtctggaacgagctcttcttatggcctttgccgttcgcaccatcctcgtcctccgcctcgtcgccggcgtcaatggcatgggctgccaccttggcgctggacatgttcgcagagtcatcggccagctggaagccgatggcggcattgaggcgccgccggaatgcgtccacggcctccggcgggttcacaatggaggtgttcgggtgctcaagcacgaacatgacaagatcgtcggtgtcggtgtaggcgacgttcagactttcgccgttcacggaaagcgtggcggcgaatcggcgggaatccacctccttcaccagattctcgggaatgtgctgggtgcccagaccaggtgcaatcgaatcaaggccgagaccgggaatcggcgtctgcggcacgcgcggtgccgtgcgagagacgtgttgcggttgaggttgtggggcggacgacatggacatcgatcgcgctagatagttggcggccgccagcaccggcatgtcttccggctggaacttcagccgaatacggggctcgtctccgagctgaaggcggtacgaggcgaaatcctgaccttcggatttcgaggaatattcgggttgccgcgactctatggcgattcccatggccgccagcttagcgcggtcacgttggaattgcttcgcgaaagccgctttcgcggcctgatcagccagttcaccgtaggagtcagcgtatgccttcacacgctgggcgatctggcgggaagtcagccattgcggaaaagcggacgacaacactgccagcacatcaagctcatgcttgccccacttatccgagaagcggcgcctgccgttactaccctcagccattagtcctcacgtatcgttatcgttttaaatcaaagtgggcgcacacaaacgccccttgtattatcataagggccttttcctcaaatggtgtactgaaacaccgaaaaagaccaaattttcttttctgcgaacaattctacagccattcgtcgggctctataccctgcggtcctacgaattcgccgtttgggacataactcggcctaccctcatcatgcaatgtcgcctcaccatagaagttcacatcacggccgaaggtccaatccccctccaccgtgaccgaggcagccgctgcaagcgatggcacgccgtaggggaagcggtcgtcgaaatcatggatgttcttgtagaagcgcgtgtcaagctggacgttcgggaagatgtagttgccgtcctccatctcgtactgatcggtcagatggaagcggtcggagcgcatgatgaacaggtcgtcggtggttttcaccggcaggaagcgcatgcggtccacctcgacgcagatcgccccattgaacagactcactgcagcgcccatcgcggtctcgagctgaatcacctcggtggtggaggcatccgttgggtcgacggtcttgtaattgcgaatgacaggcaacgggagcacgccgttgctctgtgccagcttctcgcgtagggagtcgatgcgcacccagatgttgttcgtattgaaatacggatgcttgtcgatgttcttggcttccgccgcgtcttcaggggccacctgcgtcatctcgcgcaacatgagtctaccggtgaccttgtcgcgaacgatgtgaccacccttgcgatccgcttcggtgcgtttcgacacttcgatcatgaacggagcgtcggtgttttcgaagtgctgggccagagtgcgtgacggacgtgcccccagattgtctgagttcgagatgaacaggtacttgaatccgtggctttcgagaatgtcgagcagacccgattcccagagggtcgaatacaggtcgccgtgcccgggtgggcaccattcgagatcgggattggaggggaatgacaccggctcccccgtcgaaagatcgatcttgggctccacgtgctggatgatctccatcggaatatcatcctgatggaaccgcttgtctcggttgagcaccttcatggtgtcggccgatgtgcggaacgagttcatgaacgtcagcgggagctccacgcccagtcggttgcgtgcggtttccacctgtccgagaatgatgtcgatgaagcgcatttgcttggctttgtgcctgcgaaccggcaacaatgattttgcgcagtcgagccccatcgaggttcccagaccgccgttgagcttgaggaacgccgtcttggcgaatgcgtcgaccgccttgtcgtggttgatcgtctcatagatctgcgcgaaattgggaatgtcctggaccggctcgatgtcctcctcgcgaatccaagtggtgccgtcctcgtgctgccacacatcatagagatgctcgaattgggctatggccgtctcgctcaggccgtgagccttcatcttctcggcggttcgctcgaatgcgtcggtcatgtcaaacctttctcatacgaagaggatccctgtatcgttatgccaactgtgccaagtgtagccttttttccaaggattcgcatcttttgcatgacaattcgaattcatttcctagtttcagttgaaaatatgtaaacaacgaagagaaaagaattagtatgttaattttttgaaagtctcgtccgatcatctcgaattgattccttgtaatacggcagattgatcgacgacggaaaatgaggtgggcagaaatcccatgaagtcggaccagcgggatttgaacccgcgaccccttgacccccagtcaagtgcgctaccaaactgcgctatggtccgtattgctcaaaggcaacgaatacacaatatagcagagggggcgaataatggccgacgctgcgcgcgtcggccattggaatcgctacttacggcgcttcttctcgcgaatattcaccgagatctgaatcggtgatccctcaaatccgaattcctcacgtagcgaacgctccagaaagcgtcggtacccgtgctccaggaagccggtagcgaagatcacgaagcgcggcggccgacttgacgcctgggtggcgaacagaatgcgaggctgtttgccaccacgcaccggatgcgggtgcgaggcttggatcttgccgaggaatgcgttgagcttgcccgtcggaatacgcttgtcccaagactcgagagcctgcgtcatcgccttggccaaacggttcgtgtgccaaccggtcttcgccgagagattgacacgttgcgcccaagtgacacggtcgaattcggtcttccacaaccgctccatgcgctggcggtcgaattcatccatgagatcccatttgttgaatacgagcaccaccgcacggcctgcatccaccgccgtgctcatgaccttgagatcctgatcggagatcggaatggaggcgtcgaacagcaccaaggcgagctcggagcgttcgatggccgcttgggtgcgcagcgaggagtagtactccgcgcccgacagcttgtgctggcgacgtttgatgcccgccgtgtcgatgaacaggtaatcctcgccgtcgatggtcacgatctcatccacgggatcacgcgtggtgccagcaagttcgttcaccaccgagcgttccgaatgcgagagctggttgagcagcgacgacttacccacattcggtctgcccaccaacgccacacggcgcagatgggatggcgtgaggaaaccggaggtcttttcggcgcttttcatttgcgcaacggcctcatcgagcaggtcccccactccccttccatgcatggcagagatcgggtatggctcaccaaggccgagcttccagaattcagcggccatatactcgctgatctggtcgtcgatcttgttcaccgcgacggtgacgggtttgccagcctgacgcagcagcttcacgatgcgctcgtcggtctgtgtgagcccggtgagcgcatctaccacgaagatcacggagtccgcgagctcaacggcaatctgagcctgggacgcgatggcggagtcgatgccttcgacgtcggcttcccagccgccggtgtccaccagtttgaagtcagtgcccgcccattcggcgtcatagctcacccgatcgcgggtgacacccggagtgtcctccacaaccgcggcgcgacgtccgagaatgcggttcaccaatgtcgacttgcccacgttcggacgacccaccactgcgatgacgcccaccgccttgcggcggtccgactctccgtctgcactgaatgcggagccgtcgagcagaccctcatcgccctcatcaagttcgtaatcgtcgagattggcggcatattgccggtatgcctgctcctcgatcgcgtcgtcgaccagaccaatcatcagatcgagcgtctccccgaaatcgatgtcggagttgtcgatcgtcgtcacaccatccgaagcctccgtgaagtgggtgaccttcgagtcggcggcgtcgcgtttcgctacatcatcgctgcccactccaccggtctgctcctgcctgttgcggcgtgcctgacgcacctcctctcgggccgtgagcaggatgcgcacctccgcaccgggttccacgacgtcggtgatgtcacgcccctcggctacgacaccacggccgtgcgagaacgaatcatcggcgctttgagccgcgatgtaggcacgttgcgccgcgatgagcacgttgcgcaccggcataatcgccgcgagtctggatacgtgggatgagacctcctgcgagcgaatctgctcgctgatgtcgacgtcgtcggcgaagacgccgggatgctgggggtcgacgctgatgtcgaaatggccgtcggtgaagaaggccgccacaatctccgtcacctgctgctcatccacatggtccgcatccaggtcgaccccgcgctccaggcaccaccatgtgcatgcacgatacatggcgcccgtgtcgaggtaagcgaatccaaaatagtctgcaagggccttcgacgaggacgacttgcccacgccggcagggccatcgattgccacacgaatcatagaccgacctccttcgagagtgcgcgaacctcatcctgcgacagcacacggtaggacccggatttgatgtcaccgagcttgattgggccgatctgcgtacgcaccagccgtttgaccgggaagccaatggcaccgaagatgcggcggacgatgcggttgcgcccggaatggagcactaccttcacgatggtctggtcacggttcgaatcgatgatcgagcagtggtcgagcttgatccagccgtcgtcgagctgtacgccggtgcgtacgagacgacggcatactgtgccgctcatatgaccttccaacgtggcgatgtaggtcttctccacctcgtatttcggatgcatgacgtgctggcttagttcgccgtcgttcgtcatgagaataaggccctcggaatcgtagtccaaacgccccatgtggaagatgcgctcatatttgtcgccgacgatgtcgcgcagcgtgtagcgccccttcggatcgtccatcgtgctcagcaccttgcgtggcttgttcaaggccaaggtgatgtgccgcggattcagtcgtatgcgtgagccatcgacacgtacttgctggcgtttcgggtcgactcgggtgcccagttcggtgacgagttcgccatcgacctcgacacggccgtcggtgatcatttcctcgcatttgcggcgggacccgaatcccgcctgcgccagaagcttctgcaggcgaataccgtcgccgtcgttctcatattgttttctggcttgactgtagatatgtggcatcgttctcccaacgtggccgaataacatataactttctcaatatactgtgcggacggtactccgtcaagccttgacgagcacttgcacagcttgttgagtatgatgggttccggtcgcaaaacgctttgcgtctgccatttgaatgaaggaacaatatgaccgatacgacaacaaccgcttcagtccagccaaagaaagggcatgatctgtgggcgcgtgcactctccgagttcgctgggtccctgctcatctgcttcgccatctatctcatgtgcactttcggttcggcgttctataacgtgaaccttgccttcgtcaccgtctgcgtcggcgtgatctacgcggccatgaccgcaatcttcgcacgaatctccggcgcacagttcaacccggccgtcaccgtggccgccatgctcacctcgaagacgaaggtgtgggacggcatctgctacatcgtcgcgcagattctcggcgccattgtcgccggcggattgctcaggcttgtgctgcccacctccgaaagcgtcgccgccaaccagtggtatgccatggcagtgaacggatacgacaagggttcgtcgctgtacacatcgctcaattcgctgggactcacgttcagcatcaccgtcgccatcatcgtcgagctgcttgcctccatcatcgtcgtggcggccgccatggtttcgatgcgcaagcatggcaaggtgaggtcggactatgcgctggttatgggtgttgcctatgctgccgcgtcagccatgagcttccctgtgacgggtgcctccatcaatcctgcccgtgccacaggcatcgccgtgttcgcccaggggcagggtctcacgcaggaaccgcttgcccaactctgggtgttctgggtcaccgccattctcgccgccgccattgtggcgttggtgatcatcgtctcccagctgctgggcactccgaagaccagcgtcgactcggatgtagccgaggccgccatggcacaggccggtgaggttccggcggaagatgaggccgaggcggttcagatcgccgaagcagagaactacaatgttccactgaccggagaacagaccgacaacgactattcagtgattgaggaagaggacgctgaggaagagaccgaacaggatgactcccagactgattccgcagatggagtcgaacgtcactgagcgaatcttccacgggctgcgttcccgcaacacagtccgtagcacactggttccaatggccgtcacagacagtagggctgtggcggccattgctttgccacatgcagccaatacggtggagaccaccacacagagcgccactccccattcgaatgcgggtttgccctcatggctctcagagacaaatggatgatggctgctcatggtgctcctcccagtgattgctgcatactttaccctatcccctgcatgtatgcccgtaacatgatggaaggcccgacaaccgtgcggctgtcgggccttccatgcgtcatctgccatacaccggttcgaacagccggtttcaagggcaaatgactcagtggaggaagtggcgtgtgccggtgacgtacatggtcacattggccttgcgtgccgcttcgaacacctcctcgtcacgaatcgatccgcctggctgcacgatggcgcgcacgccggcgtcaatgagaatttcggcgccatcggcgaacgggaagaaggcgtcggaggcggcgaccgcgcccttcgtgcggttgcgcccatcatcgagcgtattggcgcgttccacggccagatgcgccgaatccacgcggttcacctgtcccatgccgatgcctaccgtcgccatatcgtcggcaatcaggatcgcattggatttgacgcaacgaatggcgcgccatgcgaattcgagattcttgagcgtacgctcgtccgcggcctcaccggcaacaagcttccaagcatccggatggtctcccggggcatcaatcagatcggtggactgtacaagcaaccctccgtcgatctgcttgaactggtatttggccttggggggttcggcaaccttgaggatgcgcaggttcttcttcttggcttggagaagtgcgagggcctcgggctcataatcgggggccacaatgacctcggtgaaaatcgaacggatgtattcggccatctccagcgtcaccgtggcgttggaggcaatcacaccgccataggcgctcattggatcgcaggcatgtgccttgcggtgtgcttcggcgacggtggttcccacggccagtccgcacgggttgttgtgcttgaccacggcgacggcgatctggggggcgaaatcccataccgcgcgccacgcggcatcggcgtccacatagttgttatagctcatgggtttgccgccaagctgctcggcgtcggcgaacccgcggacattgagcggatctacatacagggcggcatcctgatgggggttctcaccgtatcgcagaatatgcgcgcggttccaggagcgggtgtattgggctgggaacttgccaagcttcacctgctcggtcggatcctcggtacccgcgtcagcgatggtgtcaatggtctcgtcgatgctcgcaggtttcggccaatgggcactggtccactcgttgatcgtggcatcgtaggcagctgtgtgggcaaaggccttcgccgccagccaacggcgttcctccaaggagaatccctcgccgttctcgatgcgcgtggccaccaaggcatagtccgtcggatcggtgacaatagcgaccgtggcgctgtttttcgcagccccgcgaaccatggatggtccgccaatgtcaatcttttcgatgacgtcggactccccagctcccgaccgcacggtatcggcgaacggatacaggttgaccaccaccaggtcgaatggcttgataccgaattcctcgagctgccgggcatggtcttcattcgtcatatcagccagaatcccggcatggatatgcggatcaagcgtcttgacacgtccgtcgaggcattccgggaaaccggtcacctgcgacacttcgatcacattcacaccgagctctgccagcttattcgcggttgaaccagtggacaccacctcggttccggcatcaatgaatgcctgggccagcacctcgatgccctccttgtggaataccgagaccaacgccctgcgaatcggtcggttagtcgtcacctttcgtctccttctgcgtaaacgtggaattgaccacgcgtggggtatggggggttttgtgttctttgcgttcgtcatcaggggaatccgcggattccaacggcaacgaagtgcggtttgcggcccgtcgtttcaacatcatgagcatgagcgagtggatggcaacgatcacgatcgcgctgatccaggatattcccagaccaatcgcacatggccttgccaccacatttgtggagcgcatcacatcaaccccgacatcacggagcctgccgactcccagcgacccattggccagccagaatgccaagctgctcatcagggagaccagtgtggccgtgatgcagaatgcgccagccgggtatgcgaagcgcaacagcaaatcgcgtacgtccacgggctcattcggatcaatgccccgcacatggaaaccccggtggagcagcaacatgagcaaaccgaacacgaatcccagcataaccggaatcagcatcagacaggtgcgaatgcccgcattgtcgacaggatgggggaacaaagcgaatatgggaagcgaaggcaactcgtgaatctgcgccgaccacaacgaatatgaggcggcctgcccaatgtggaatccgccgccgaatacccatgacaatgcccataacgccatattgggcaaccatgccaaggccatgatgcacatgaggatgcgcgatccggtgttcatgtgcattgtcttgaacatggtgaccatgctggaatgatccagacaaatccaaacgaacacggtaatcaaaccgatggaaaggaatatcaccagcaatcgcaaggccagacgcacaccgacatgaatgctggaacgcactggttgggagatgtgctcgcggcagtagaggcgccccctgtccatcagtgcggagccgggcaacgctctccacgcgaagcccagggaaaacaccaccgcacatttgagcgcgatgagccaaatggaatcggtgagttggatgcgtgtttcaccgctgcaccataggcagagcacaatccaagttgccacgcccgcaagataggctggcagatccgtgctccagtgggagtagacggcacggattagcaggatcatcgctagtgtcaggagcaaaggcgtgatggtcagggtaatcgccccggcatgcatgccgataccctgactgagtaacacaatgactctggtgagtgggacagcgaacgacgacatcgtctcgccgccctcttccatggcgaagaccagcagggccagcgccatgaacacaccgaccggaatggcgaagatcaccatgaccagaaccggtgcgagcacacctttcaaccagggcgttatctgcttcatcatatctgcgcggaaagcacctcacgcatgatctgcgcagcctcggagggggttctgcccactcggatgccggccgcctcaagtgccgcctgcttatcctgagcagtccccttgcctccggacacaatggcccccgcatgccccatctgcttgccttcgggggcggtgaatccggcgatgtaggcaacaaccggtttggtcatgttcttggcggcccattgtgcggcatcctgttcggcattgcctccgatctcgccgatcatcatgaccgccttggtgttcggatcggcttcaaaggcttcgagcgcctcgagcagcgtggttcccacgatgggatcaccgccagcgccgagacaggccgtgaaaccgatgtcggagagttcgcccatgagctgataagtgagtgtgccggatttggataccaatcccaacgggccacgcgagacgatgccgtcgggaatgatgccaaggttgacgccatgtgtatcggtggattccggcaaggtgaggaggcccggacagttcggcccgacgatgcgcacgcctttgctgagagcgagttccacgaaataggcggagtccgccacggggatgccctcggtgatcacgacaaccacctcgaagcctgcttcgacggcttcgacaacggcgtccttggcgaaacgagggggaacgaacacaaccgatgccttggcaccggtgatgtcttttgcctcctggcaagtggcgaacaccggtaccctgacggggacgccgtttccatcttcgaattcgagggtggtgccggccttgcgtgggttcacgccaccgacgatattcgtgttggccttgagcatgcgtgcggtgtgcgtcatgccctgatgaccggtgatgccctgtacgatgacgggtgcgtcatcttcgatgaacacgttcacttaacgctcctccttgccatgggcggcgagacgagccgcctcggcggccgcctgccccatggtctcgcatacatggatgttcgggttatcggcctcggcgagaatccgaagcccctcatcggccttgttcccctcgaaccgaacgaccatcggcttggatgcgccgagctgatccgccgcctcgagaatgccgagagctacctgttcacaggaggtgatgcctccatacacattgatgaacacggattccacctgggggtcggagagaatgatctcaaggctttcgcacatgacctgcgaggaggctcccccgccgatgtcgaggaagttcgcggccttcacaccggtgccctgttcctcgcccgcgaatgcgacggcgtcgagggagctcatcaccaagcccgccccgttgccgatgacaccgacctcgccggtgagatgcacgtaatgcagattgtgttcacgggcacgctgttcaaacggatccgggacgatcgggtcggcaaagcgcttccatccatcgtgacggaaggctgcgttgtcgtcgagtgagattttcgcatccaatgcgcacaacgacttcgaagattcgtcgtccgggtcgccgactttggccaatgggttgatctccacgagggtggcatcgttctgcttgaagcagcgccacatgttgagcaggatctgcgccgcctgagctgaatccgcgtggtagaagccgatgctctcggccatttttgttgctgcttcgaggtcgaagtcctcaagagcgcttatatgcagccgtttcacagattccggatgcttgcgtgcgacttcttcgacttcagtgccgccgttggccgtggccaggacgtcgaagtcgcgcgaggagcgatcaaccgagatggacacatagtattcgtggaggatgttcttggcttcggtcaccaggatgccactcaccttatgaccatggatggtcatcggaaggatatcctcggagatgagtatcgcctcgtcacggtcatgtgcaatgcgcacaccgcctgcctgcccgcgatgtccgatcttcacctgtgccttgatcacgaccggatatccgatgatgtcggcggcttcggccacctcatgtgaattctgtgcgaacaccgccttcggcacatcgatgtcctgctcttcgagcagctgacgtgcctgatattcgtaaagatccatattcctctactccactgtttcctaagcgggcatcttcaacaacgagccgtatggatagtcgccgagcgccgtccgtccgtcaaggccctccaattccatgacgaattcgtagcctgcgaccttgcctccagccgattcgatgaggtccttcgccgccgcagccgaaccgccggtggcgatcaggtcatcgacaatgagtatacgttcattgtttcggacactggtgtcttcgatctccaaggtggctttgccgtattcgagtgcatagctgcatgcatgcaccggtggaggcagcttcccggccttgcgaatggcaatgaatcccttgccgagttgtgcggcaagggcaggtccgaacaggaacccacgtgcttcaaggcctgcgaccgcatcgaattcgtctgtgtgcaccggtaaagcggcgatgagcgcgtcgaggagaatacgaagccctcgggagtcggcgaatactggcatgaaatcgcggaacaggatgccttcgcgggggaaatccggaacggtgcgaatgagtgagatgaggtagcgggcatcgtcttgcgacatgctggcagcattggccacatgaatgtcggtctgtgacatgttcaccttcgttgatcggcgggttggcggtggtattggcagtttacttggactgtgtttcgaacggtgaggaatccgcgtcctccggggtctcaaccacggaggtttcctccacgacggtctcggaaccgtcggattccggttcgttcgaggtaatctgcgccggttcgtccttcggcagtggattaccgttctcgtcgacgtcgtcgtcgctcacataggccggacgaacataggcccggctgaccgactgcaggctgaagcgcagcagcgatccttcggagtcgagcacgatttcttcgtactgctcgtccacttccacgaccttgccgatcaggcctccgatggtgatgacctcagtgcccggagcgaggctcgtgcggaacgcctgacgctcctgctgctgcttcttggccttccgggaagagtagaacatcataacgcccatgaggacgatgagaacgatgagcatcatatattccatgagtggactccttaaaaacatgagaaggggcaatagcccacgaaatcctaagcttagaatagcttgctgacatcatcgggggtaccgtcgtcgggtttgagacccaaatgctcccatgccttggcggtggcgagacggcctttcggggtgcgaatcaggaagccttcacgtaccagatacggttcgcatacagtctccactgtctcggcctcctcccccaccatggcggataggttgttgagacccaccgggccaccgttgaactgccggacaattgcattgagcacggcgatgtccaggcggtccagtccttcggaatcgatttggtagagagccagtgcgtctttgacatcgtccgcccccacgctgtcgagatcgtgcacgatagcccagtcgcgcactcgccgaagcaaacggttcgcaatacgtggtgtgccgcgtgagcgcagcgacaactgtcgcgcagcctgatcctccaatgggaggccaagcacggaggcagagcgttcgatgagtttttccagttcctcgtgagggtagaaatccagatgcgcggtgaagccgaatcgggcgcgcagcggtgaggggagcatgccttcgcgagtggtggctccgatgacggtgaaccgaggcagcgtcagtggaatagaagaggcaccaggccccttgcccaccatcacatccacgcggaaatcctccatggctatatacagcagttcctccgcggcgcgtggaagtcggtgaatctcatcgatgaacaacacttcgcccacatccagcgaactgagaatcgaagccagatctccagcatgttgaatcgccggtcccgacgtgacccggatgggcaccccaagctcattggccacaatcatggccaatgtggtcttgcccaagccgggaggacccgccatgaggatgtgatcaggagccacatcacgtttgcgggcagcatcaaggaaaagctgcagctgggccttcagtctgggttgccctatgaagccctccaacacatgaggacgcagctcctcgtcgctcaccggttcattgccgaccggcacggccgacaccatgcgcaacgattcatcccgggcatcgaggttgtcggctccggaatactccattggctccatgttcgcgattgccacgaattacctccctctgtccagtgatgtcaatgccagtctgagcacagtcggcacattgccttcctccagtggcaacgcgatgccactggaggaaatgaccgaatccacagcctgctgtgcatccgcctgcttccagcccagcgacatgagaccctcaaccacctgttcgacccccttgtcggttgggatgcgttgcgtggaagttggctcccctgtttcgattttgtcgacgtcaatcgagcccttgagctccaggatgattttctgggcacctttccggcccagaccgggggcgcgtgacaaggccttgtcgtcaccgtcgtggattgcctgtgcaaggtcgtcgggggccagcgtgctcagaagcgaaagcgccaccttcggtccgacgccactcaccttctgcagctggaggaacatgcgtttcgatctggcgtcgaggaatccgaacagcgtgatggcgtcctgcgagacgctcatggatgtgtatattttgacgtcctggcccatatgcatggcggtgagatcgttggaaggcatacgcaattcgaatccaaccccatggacgtccaccaccgcattggaagtgtccaccgactcgacccggcccttgagcattccgatcattagtcctcctgccgaattcgaacatatgttcggtagtttacatgcctctgcggactccccttctacgggtggcatgctgcgtggcctgtgcccattggcgttgcgccggggtgagatgttgctcgcgttcgccgccttcaagtgcaccggatgggcgcagtgcatggcatatggcgatggccaaggcgtctgcggcatccgcgggtgtgggcaatgcgttgagattgagaatccgagccaccatgcgctccatctggatcttctccgccttgccgttgccggtgatcgccattttcgattcggtcggcgtgtgaagcgccaccggaataccgcgctgggcggcggccagcatggccatgccggccgcttgcgccgtaccgagcacggtgtttcggttctcttgggcgaacacacgctcgattgaaacggtgtcgggaatgaattcgtccatcttcgcacacaggccgtcgtagatcttgagcaatctcagatcctgcgattcgtgcggatcacttcgcaccacatcgacgtgaataaacgaaagccggcggtatgcgccggcttcgatcacgccgaccccgcagcgtgtgagcccggggtcaacgccgagaacgatcacggatgactactcctcgtccagctgggcgagcacgtcgtcagacgcggtccagttgctgtagatgttctgcacgtcatcgagatcgtcgaggttgtcgatgagcttcgacaccttgcgcgcgtcgtcgaggccaagctcgatctcgttcttcgggcgcatgaccagatccgcggagtcgtaatcgacgccggcatcctgcagggcctgacgcactgtgatcagatccgaaggagcggtgacgaccgtgtaggtgtcgccatcgtcgatcacatcctcagcgcctgcttctgcggccttctcgaacagatcgtcgaaatcaagcccctcggacggcacgacgatctcacccttgcgctcgaagttgaagctcacggcaccattggtggccagcgagccacctcccttgccgagggtggagcggacgtcggccgcagcgcgattgcgattgtcggtcaggcattcgatgatcaggccgacgcctgccggtgcatagccttcgtagatgatctcctcatagttggcgccgccggcttcggcacccgatccacgggcgactgcacgcttgatgttgtcagcgggcatggaggccttcttggccttgtagatcgcgtcatagagcgccgggttgccatcggggtcgccaccgccctgacgggcagcgatctcgatgttcttgatgagcttggcgaacagcttgccgcgcttggcgtcgatggcggccttcttgtgcttggtggtcgcccatttggaatggcctgacatattgctcctacaaagattgcggattcttagaacgtgttgattttacagcgtttctatgacaacgccttcgcatacacctcgagtacctcatcgaccacggtattccagtcgaagctcctggagcgtatggaaccggcctgtgacagggattggcggcgcgccggatcctcgatgagctcggtcatgcggcgtgcgcaatcattcgcatcgcgattgacgaacaatgctgcactgctcccctcctcggtgacggccctgaacgcatcgaggtcggaggcgatgacggggcagcccgcggccatcgcctcagccaacacgatgccgaagctctcgccgccggtttgcggggccacgtacatgctcaacgagcgatagaacctggctttgtccgcatcgcttacacgtcccaggaattcgaagcgttcccgcagccccttgtcggcgccaatggcgtcgagtgtttttccgccgtcctcctgtccgtcgcctgcgacaaggaaccgtgcgctcgggaatgcctcatgcacaatcttcgcggcctgagcgaacaccgtgaatcctttgcgctcctcacccatacggcccaggaatccgatggtcggcgcctctggactgccctgccattgtgggttcggctccgcgcgtcggtagaaatcgcattcgatgccattggggatggtctggacccccacttgctgtggcagatagtgttcggcggtcttttgtgcggactcggagacgaagatcgcttccctcagcggcgaaaggtatttgcgcaggtagcgggtgaacaatctgagcgcgcgtggatatggttcgatcgaggcatggaatgtggccaccatgggcggcgcatcatgcatgacgagaggcttgtggctcagtgaaggggtttcgggttcatgcagatgcagaatgtcaaaaccgccgtcacgcacccattttctggtggtatggccggcgttgaggaaatagctcagatgcgcccacgatccgttgtacgggatggcgaacgaggagttgttcgtatggacatattggggcatgtccgcggttctcctgcctggtgcgaacacttggacctcgtgccagcgccgacgcagttggcgggcgaaatcgcgaatatggttctgcacaccgcccggcgtctcgaacgagtatgggcagatgatgcctacacgtagtgcgttctgttgtcctgccgttccgctcttcgtatgcaaagacggcgtattcctgtcaaacgatggcatattggcatcttgctcgactcgctggactttcaccgtgacatcgttgcttgtgctcgcaactcctcggggacgtctttgagacgctccatatccagatcctccaggaatatcggttggagcatgtgccaatcctcagggtgtgcggcgatgcctcttgcccagatgtccacccaatcctggcagatgcagcggattgcctcctcacgaggcatggaacggtatcgctccacatcgatcggcccactcacttcacatacgtatccgtatggtgtgcgcgccaagcggcgtcgttccccgctgagtttttcgcggtaggtgttgacgacgaacagtggcgttccggtgtcgaatgctattgcggccggtcccctggccactcggatgaacgatccgaatgcgttcacgaattcgccatggcggctcagatcccggtccgcgagcaacggaacgagcgtatgcggagtccgcagtgcctcctcaagacgttcggtgagcttcggcgtgcctgtcaggaagatggtcatgcccagatgttcgcgtatggacacgaacgcgtcgagcatctccctgttggccagtttctccgccaccgtggtcaccggtgccacatcgaattgcgcccagaacccgtcgtagtcccaattgccctgatgtcccatggcgatcggagcggagcctgtcccctccgaacccgcctgatgtttgatcgcctcgaatccgtcccctgaaccatggatccgcgcaagcaattgctccttggatcgcgcgccaacggtcattgcctcggagaaataggtgaaatacgaacgcatgcccttgcgagagagtttgcgcaacgtccttctatcgggatccgttccgtcacgccaggagagcacatgggctagattgcgctccagctgccttaccgaaccgatgtgcaatgcccacgtcacatccgcggcagcaaggaacccccctcgaaccatacgctcgggcagcgcgttcgggtggcgtgcgagccatgccatcaatctgtcgaacatcacaattcgcctttcacactctgcctatgagcccggtcgtacaggcgacggctgcgtgccgtcactgcttggagacgccggcgtcgccgttggctcgcatgctcacatagacctcgcggatgcgctggaacacggtgatcgtgccgagcaatgcgagcacggccatgtcgatcatgagccagagcggattgttggccaggccgcatatggccatgccgaccaggatgatcgtcaggcggtcggaccgtgtcgctacgccgtttttcgcctcgtagccgactgactgtgctcgtgcacgtgcatatgaggtgacgaacgaggtcatgaccgaatagattgccaacgccatgccgctcacgcaaatccagtcgtagcgttgcccggcgtgtgctgcagtgaaggtggaattgcgcacaaagaaatagatgatgcagccgagcagcacggcccagtcggctatacggtcgagtgtggagtcgaggaatgccccgaatttcgtgcctcctgtggtgattgcggccacagaaccgtcaagcgaatcgaacaccaccagaatggtgagtaccaaagctccccagaacatccatccggtgattccggatgcgatgccgacaatggtggtgccgaccgccccgatgacagtcaccgcgttcgcggtgatgcccattcgcgtcaatgcgcgtgcgatcggcgcgatgagccgcttgaaccatggtcgaagcttttccagcatgttgtgtcctggggtcaatgagtagaaacactatgagaatagacaacagcgcagatattgcttgcgaatggctttggaaaaacaccggtggggccggcgctggaatgcgcctgaccccaccggtgctgaatgccgtgatattcgcagtgcgtcctgttttactcggcgtcggtgtctgcgacgccgaactcgacattctccacaggctgcccggtggctgccttgaagtcgtcgacgctgttgacctgcacacgcttggtgatcgtctccagaatccacgccttggcttggtcgaccggcacgccgttgagttggctgccgtcacggaagcggaagctcacggcgttgttgttcatatcctcctcgccggcgatgatgatgtacggcactttcgatttggaggcgttgcggatcttcttgccgaaacgatcatcggaattgtcggtctcgacgcgcacaaggtcctcttcgagcgaattcatgaacttgtcgagatgcggggcgaattcgtccgccaccggcacaccgagagcctgcacgggagccagccacgccgggaaggcgccggcatagtgctcgagcagaatcgcgaagaaacgctcgatggaaccgaacaacgcacgatggatcattacggggcgctggtgcgatccatccggagcgatgtactccaactggaaacgctccggcagattgaagtcgagctgaatcgtggagacctgccaagtgcgtccgattgcgtcgcgggcctgcaccgagatcttcggaccatagaatgcggcgccacccggatccgccacgagttcgagaccggattcctcggccacctcggcgagggtgttggtcgcctcctcccagatctcgtcggagccgacgaacttgtgctcgtccttcgtggaaagctccaagtagaaatcgttgagaccatagtccttgagcactttgagcacgaagttgagcaggttcttgagctcgtccttcatctgctcacgggtgcagtagatgtgggaatcatcctgagtcagaccgcgcacgcgggtcagtccgtgaaccacgccggacttctcgtagcggtagacggtgccgaactcgaagaggcgcaacggcagttctcggtaggaacgctggcgtgacttgaagatgaggttgtgcatcgggcagttcatcggcttgaggtaatagtcgaagccctgcttgacgatgttgccgttctcgtccttttcctcatccagatgcatcggcggatacatgccgtccttgtaccactgcaggtgtccggacgtctcatacaggccgcccttggtgatgtgcggagtctgcacgaagctgtagtgattcttgcggtgcatctcgcgggagtagtcctccatcgcgttgataatcgcggcgccctttggatggaacacggcaagacccgggccgatctcgtcagggaacgagaacaggtccatttcctgaccgagtttgcggtggtcgcgtttggcggcctcctccatgcgggtctggtaggccttgagctcgtccttggtggggaacgccacgccgtagatgcgctggagcatggggttcgcctccgaacccttccaatacgcggcggcggcgcgctccagcttgaatgccttgatatagcgggtgttcggcaggtgcggtccacggcagagatccgaccacaccacattgccctcacggtcgagattgtcgtacatactcagctccttatggctgatgtctacggccgcctcggtctcgagcgcatcttccttgtctttgatgagctcgatcttgtacggctcatcagcctcttcgcgcagggcctcctcttcgctcaccactcggcgctggaagcgctgcgccgacttgatgatgcgttgcatgtgcttttcgatggtcttcaggtcatccggcgtgaatggatccttcacgtcgaagtcgtagtagaaaccgttctcgatcaccgggccaatgccgagcttggcatccgggcgtacctcctgcacggcctgtgccatgacatgggtggccgaatggcgcatgatgcctgtgccatccggcgagtcgagggtcacggattcgacgttgtcgccatcgtgcagaggcgtgtagaggtctcgcaactcgccattgagacgcactgcgatgatgttcttgtcgtctgcgaacagttcgacgccggtctggcttgcttccacctccttcgcctcgccgttgactgtgatggagatgtgtgcttctgccatgaggtgtcctttgctatctgggtccgcggtacaaggtgcagacctggactatgtagtgttacgacataaaacttagggttcagttcagacaaagtggctcccctgtctcacacctgacaggcttcggcgaaccaatgtgagcagatggcagcgcgattcggacgtgccgtcatctgctcgaggcggattgccttcccggtcggtatccagacccattcactgttttccgcagacttcgtcgaggaaccaacgctcgtgactcaccacgatcccgcgtgtatgctcatcgacatgattcgtgggctcgtcgagtaccagtacatcgggacgggagtatagcgcacaggcgatctgcagacgtttgcgctcgccgccactgagggggtcataccggtaaccccaatcgtcgccgatgccgagtgcgtcgcgcaaggcaatggattcggcgaaccagtcatcgcggaactctgcgagtccctcaggttccgaaacgcattcctgtttgcagtacgcgcagatgagcgtccgcggactcggctgtacttcgccccgcgtaggtgtgcgccgtccgcagatcagttgcgcgagcgtggtcttgccgagaccgttgtctgcgagcaacgcggtccaaccgtgtgacaatgacgcgttgaaatgatcgaacagcggttcgctggaatctgtgtattgatatgagatgtcgtgaagcaccagattgcctaccatgtcagctccttgccgatatggcgtactgcatatgtgtgaaacagcgagtaagacctgaatgcgaatgggaatcactgtgcacagtggacacggcagcacgcgtaacgcgtctggtttgctgggttactcactgtgtccagatgcgcaagtgcttgccgacctccgttgagcattctcttggcatgtgggagaatgtgcttgaaaatagaagagagcggacaacgggactcgaacccgcggtctcgaccttggcaaggtcgcgctttaccaactaagctatgtccgcatgtgcttgaagcacgagttattaatttactataattttccgattgcgcaacttcggcgtgtcgtgtatgttcagatagcgcacgacaccggtggaaaggaactgaacatgagtgagatttccattgccgaaaacacgcagctgcagacaatacgcgatctgagcatcgccaccttcaggcagacgttcgccggtaccaataccgaagaggatatgcgcgactatatcgcccatgggctctcccccgaggtgttgggcaaggagctggcagacccgctgcagacgtttttcgtcgcaacggtggatggtgtgccggcagggtatatgaaggtcaatctcggcacggcgcaaacggagcgtatgccggacgaccatgccgaagtccagagactctacgtgcttgcggatttcaaacgtcacggtttgggaaccaggttcatgcgtacggcagagcagttcgcgtcggcacatggcaagcaaacgctgtggctcggcgtatgggagcataacgaaccggccaaggcgttctatcgtagaatgggattcgtcgaaaccggtgcacatactttcgtgcttggatcggatgcgcagaccgacctgattatgaaacatgcattgaccgcttgctgatcacatctttcgccctgttccccgatgcccgctggtgtggcacggtcatcgatagaggtatttcccttcatccatgttgcgggcaatgtcctgcaattcggaggcgagacgcctgtcttcctccgatccgtcgcgcaagcggtgcgccttgcggtctaggcggtactcattggcgaaatacacggatatcgcgaggatgacgattgccgcgatgatccagaccattatttcctttcgatgggcgtattgtgtgcttcgtattcatggtgcaatcaggtatacgccatgatcagtatgaatggggtcgcatagcagagcagaatgaaaaccgctctggagagcagccctctgagggtcaccggacgcggaacgagcctgttcctgcttgtgaggtacccatacgtttcggagacgaccgcgtatatgatcagcatgaggatcaggaacacggtatcgacccacctgcgctcaccccataccagggcgcctgcggcaatcagatagatgaacgtcatgacggccgtgcaccaatgaaaactgacgaagtgccgaccgagtcggtaaaccggcctcgaggtggcctgccatatcttgcgagccaacgcgaaagctctgtttgcttgccgttcattcatgactcttcccttcgtccctcatatcaggtgcgccctctttcgcctgcccatctggttgccgccgtacattatgcagatgcctgcacagcactatgactgcggtaatcaccgcagtccaaaaggccattgcactgatgaaaagcgctgtcatgcacattccccctgccatggtctgcatacgagggcaagcaccatcgcaatggcatacgcttcctcatgcgtgatggatattgttgcatcattcctcggctagcgatacaaccgggaatgagaagcacccctacccagccacttaatatacagttcgacccgtgcccgatacaatgagcagtgcctgaatagtggtttataagtcgtattctgtctctgggcgtttcattccccttctcggtattggggacggtctagtattcttggactccgtcgtcgttgtcttgattaagccatgagacccaatccttgccagggccgaccgatatttattcatgcgtctcagctgccgccccaggcgcacaacacgcttagttctatacgcccggcatgtcgaccctgatgccaacggacaagccgaaacaaaaagcctcgtggacaacagtccacgaggcctcaggtgggtgatgtaggaatcgaacctacgaccccttccgtgtgaaggaagtgcgctagccgctgcgccaatcacccgtattcagttattgtatccgatggctcggatcgtgggcgatacaagattcgaacttgtgaccccttccgtgtcagggaagtgcgctacctctgcgccaaccgcccggttggtcccgggcatctttcgatgccgtcgaggtgggtacgagagtcgaactcgtctatacggctttgcaggccgctgcctaaccgcttggctaacccaccgtaaggttcgttaaactcatcggaccttagagcggacaacgggactcgaacccgcggtctcgaccttggcaaggtcgcgctttaccaactaagctatgtccgcatgtgtttctggcgttgtttcctctgcctgagcacgagtcactactatatcgaactcctggaagtttgcaagttcggcgtgtcgtaatcgttggatcatctctccgtataggattgcagtagagagatacacaacagtgaccgcgcgttttgctcacggttcctccacattgcttcactgtgggattaccttcacaaaatgcagcttttcaagggatacagtggtgtccatgaatgagcgaggaaccagagtcaaatacgtcatggtcgcggccttcgatggctggaatgacgcatgccagagtgccaccgatgtgattcggcatctggtctcccgttataggtctttggagattggccacatcaacaaagacggatactacgattaccaatccgcccgtccaatgcagtgcaccattcagggttcacgttgcatcctatggccgcagaccgttttctatgacatcgcagtgagcgactcgcttcatattcttgcgcaattggggccggagccgaactaccagtggcttgaatactgccgcggtagcctgcgtttcgccgaacagtatgacgtcgaatgcatcgtcacgctgggatccatgctggcggagtgcccacacacgcgcccgttgcccatagatatctcgaacaacggcaagccgctggatcctgattatgaatacaatgggcccatcggaatcacgcatgcgcttgacatgatggccatcgaacagggattcaacaccacatccctgtgggtttccatcccccgctatctcgggtccgctgatccatgcccacaggcaaccctgacactgttgcgggagctcggcgagatcttggggctcgatcttccggcgggcaccatagagaacaaagcgaaacaatggcgttcccggtgcgatgtcaccgtgcgtaacaacgttgatttcgagcatttcgtgagtcagctggaacgtgattacgatctgcatcagcatgccaaggaactttcgtcggcggggacgccgatggctgagcagctggtgcaggaggccgaggcattcctacgggatcaggattgagagccagttctccctagcgccataggcctcctgccttggatatgagaatacctcccgaatcgggaggtattctcatatccaaggcaggacatatcaggcattaccggagaccggaatgccctccagcggcgagagcacgccgcacaacagcaagatagccacgatgatggccagggcgatgcgatagatggcaaaggccttgtaggaataggtggatacgaatttgaggaatccgatgatcacgatgtaaccgaccacaaacgccacgacggtggcggcgatggtggcgccccatcctgggaacatcgcgtcggcattgacgtctttgatcgccttgacagcttcgagaatgcctgcgccgaacacggcggggatggccatgaggaatgcggcgcgcactgccgcctcgcgtttgtaccccattgctcgtccgaaggtgatggtgccaccggagcgtgatacgcccggaataagcgcgagcatctggccgatgccaaaccagatcgcatccttcgtgttcatgtcgtcgagtgtcttgacctggcgggcgcggtcgtcgacaatccacaggatcacgccgaatatgaacagcatggccaccgtgatccatagattgcgcagcgtcgtctcaatggcatgctggaacagtacgcccgcgatgagaatcggaatggtggcgatgatgatgtaccagcccagacgagcgtccttgttatgcgctccgaaacgagaggccctgtccttcccctccttgccggcgaggcataggcaccaggacttcaggatgttccagatgtcgcggcggaaatacagcagcactgccaattcggttccgatctggatgatggcggtgaacgcggcacctgggtctccgccgagcatgagatcgccgacgatgcggacatgggcgctggaggataccggcaggtattcggtgagtgcctgcaccagtccgaggaatatggcctggaagaaattcataaatcctctttacgaatgatttcatggttattgcagtttcactgtaccgtgtgcccttcctcttccaccgaaggaggcgatagtcgcacaggtcatcgagcggcattccgtgccgtttcgcgacatcgaattgcgtacaatgaacaccggaatatacaggcgaaaggactgagatgggtgcagaataccgtaagagtcgcaggaatgcgccacggggcttcttcgaatgcgagggcaagggtctcgagtggcttggcgaggcgcaggcgcagggtggcccgcgtgtggtgaaggtgtatggctggggtgacgattaccttgacatcgagcgggtgacccccgcgatgccgactgggaaagcagccttcgaattcggtgccgcacttgcgcatatgcatgatgcgggcgcgccgtattttggatcggctccgaagggatatgacggcacctgttatttcggacccctgcaggatcctgtgccaatggacaccggtgagtggcgtgatccggcaacatatttggccgaaggccgtctgcgtccgatggttcagatgggaatcgaacgcgggtcgttgcgtgatgccgacatggatctcaccaacgaggtcatcgatgcgcttccggaactgctcggcagggccggcgaagatagacccgctcgtgtgcatggcgacttgtggagcggcaatgtgatgtggacggcagacaccggcgagacgcaggccgtgctcattgatccggcggcccatggcggacaccgggaggaggatctcgccatgctccatctgttcggcatgagttatctgacggagatcaccgatggctacatgtcggtgcatccgctgaaggcgggttggcaggagcgcatcacgatatggcagctctaccccattgcgggccactgcgtgttcttcggcggcggttatgtgagcgagtatcggcagatgtgtcgttcgctgctgcggtgaatagctgtcggcggcagtgaatgtgatctatgcgaggggtcggtgcgacatccagttggatgtcgcaccgacccctcgcatagatcacataaatcagttgcgtcgccagatgctaagtgatttcagcctaaggcgtctttgatcttgctgaagaagcccctcttctgcggcgttgcgggctgcgaggactgccgcaccggtttttcgtccttctgctgttgggcgaactgctccatgagactgcgctcggagtcgctgagcttcgtgggaatctgcacgttgatgtgcacaatcagattgccacgttgatccttatcgttgagctttgtcatgcccaggtttttgatctccacggtctgttccggctgcgtccccgcggggatgtcgagttgctgcttgccgtcgaatgaatcgatctccattgcatgccccagcacggcccatgtcatgggaacgcgaatccagcagtgtaggtcatcaccctgccgcgtaaacctttcgtccttgcgcaccgtgatgtccacgtagagatcgccgggctgcccgttgcattcgccagcttctccctgacccggcacgcgaaggcgggaatcgttctgcacgccacccggcacagggatcactacgtcacgctcggtgcgcacacgaccgcttccctgacattgggtgcaggggtgttggaagatgttgccgtgaccttggcaggtttcgcagggcaccgaggtcatcatctggccgagcagtgtgcgcaccaccttctgtgtgtagccggacccatggcatgtggggcatgtgatgggaggctcctcgtgctcggatccggtgccttcgcagttctggcaggtgccgtaggtcgaaaacttcaggtgttgttccgcgccgaacacggcggtccgcaaatctatggtgagctcttcgagctgatcgcggccaggctggctacgtggtatcggaccgttgccggtacctccaccgaaggcgtcgaagaactggccgaacacgtcgcccatgtcgaatccgccgaagggctggccgccaccgtatcccgctccgcctcggggatcgttcggatcgacgcccatgtcgaacatacgccgcttctccgggtcggaaagcacttcgtacgcggtgttgacctccttgaatttctcctcgaactgcggacccgcgagatcgggatggtatttacggctcatcttgcggtatgcgcgcttgatctcctcttccgtcgcatcgcgctcgacacctaggacactgtaataatctgccacggccactctttctgttgtgctgggacgtattcttatgactgtatattgctactcgaaaggttcggctgttattcctgccatccattatggccaacgcgcaggaactcggtcagataccgcgatacggcatggacggcggccatggtcaccgcatagttcatgtgggtcgggccaatggatccgattacggcgatcggcatggttggcttggtgcctgtgtcgtattcctcatgctcgacatttgcgctcggggtggagctctgcccatagccgctgctcaccacggaggcatgcagcagacctggcgtgtgtgtctccgagccgatggccacgccgacaccctcctggccaggctgccccgtcagatcgtacatcaggcgcatcaacaccacctgttcctccaaagcatcgaagagcggtgcaaggctggcagcatcgatatgctgatgtgtcaggcttgcggcacctgaggtgaacaactcgtttggacgctcctcattctccatgtcggagaacaccgccgcgatggcatcgcggagctggggggtgaatcccccctcggagtcggttggcagcgtgcgaatgctctgcgcgcattggcggaacgtgagcaggcggcaatgggtattgatcgtttcgcatatgcactgcgtctgctcggtattcggcaacgtgtccgtcgagaccaacctctgcaccacgcggcccgtctcggttatcgtcaccagcaggagcgtatgcgcggcgaggggcagcagttccacgtgcctcataagggaccgggacaacgacggcgccgacaccattgcatattgaccggtgatggtggagagaatgcgtgcggcgcgctgcaatgtgtcctgcaggctcgccgaaccgctcagggcactgctgattgattcccgttgctctgcggtgagcggtatcggtgtgctcagcgaattgacgaagtaccggtatcctttttcggtcgggatgcgtcccgccgaggtatggggctgggtgagatagccttcatcctccagcgcggccatgtcgttgcggattgtggcagggctcactcccaaatggtgcttggccgccagcgcaccggatccgatgggttcctgctgccgtatatagtcctctacaacggcccgcagaatctgcatgcgacgtgtcgaactcatatataccccttattacgctttcgagaaacattgtattagcactctgcatacaggagtgctaattccggctcacagagaaagcggataacacgccaaaggcgcggaatctcgtcggttattgcggttagtatgtaagtgcaatgtgaagagcgccggcgttgttggacaagccggcggccccggcgctcgaaatattggaaggaaagtagatcacttatgaccgataacacctggtctgaattggatgagcgcgccatcaagatggcgaaggccctctccgccgatgcagtgcagaaggcgggccacggtcatccgggctccccgatttcgttggctccaatcgcctacacgctttatcagcgtttcatcaagcacgatccgaacgacccgaactgggccggtcgcgatcgtttcattctttctggcggtcatgcatcgcttacccagtatgtgcagctgtacttctccggttatggcctgacgctggatgacctcaagtacttccgtggcggcgcggatacccgcactccgggccatcctgagtacggcctgacccccggtatcgaaatgaccaccggcccactgggtcagggtgtcgcatccgccgtcggtttcgcatatggccagcgttacgagcgcggcctgctcgatccggatgctccggagggcaagtccccgttcgaccacaaggtgtgggtcatctgcggtgaaggcgacatcgaggaaggcgtctccggcgaagcctcctcgcttgccggcaatgagcagctcggcaacctgttcgtcttcttcgacgccaaccacatccagatcgaaggcgagaccaagatcgccctcgacgagaacgtgatcgagcgttacaaggcctacggctggtacaccgatgaattcagcttcatccagcccgacggttcctacaaggaagacatcgaaggcctgtccaaggtcatcgagaaggccgagcaggtcaccgatcgtccgcacttcatcaaggtcgacacgctcatcgcatggccgactccgggcaagaccaacgatccttcgtcccatggctccgctctgggcgacgaggccgtcgcgggtctcaagaaggccctcggcctcgatccgacgaagaccttcgaggtggacgaagaagcactggcccacgcccgcaaggtcgcagagcgcggccttgaggcacacaaggaatgggatgatgccttcgagaagtgggctgatgccaacccggacaaggctgctctctacaaccgcatcaagaacggtgagctgcctgaggaattcgacaaggccattgacgatctcgaagccggcttcgaggccggatccaaggtcgcaacccgcaaggcctccggcgctgtgatcaatgccatcgcgccgatcatgcctgagctgtggggtggctccgccgatctgggtggttccaacaacaccaacatcaagggcgccgcgtccttcgctccggcggaagatgccaccacccagtggccggattgctccccgtatggccgtcagctgcacttcggtgtgcgcgaattcgccatgggctgcatcaccaacggcatcctgttgggttccgacacccgtccgttctccggcaccttcttccagttcgcagattacatgcgtgccgcagtccgtctgtcggctctcatggagatcccgaacctgtacatttggagccatgattcggtggccctcggcgaggatggcccgacccaccagccgatcgagcacctgagctccttccgcgacatcccgcagctcgaagtcgttcgtcctgccgatgagtgggagaccgccgaagcctaccgttacttcttcgagaagaagaacacgctgccaacagccatggtgctgacccgtcagggtgtcccgaccctcgtcgagaccgccgagaaggccaaggaaggcgtgcgcaagggtgcttacgtgctctacggcgaggaaggccagccggacgtgatcatcatggcctctggctccgaggtccagtgggccctggaaggtgccaagaagctggcgcaggagggcatcaaggcccgcgtcatctccatggtctcgatggaatggttcgaggagcaggacgacgagtacaaggaggagatcctcccgaagggcatcaaggcccgcgtctccatcgaagccggctccgcgatgtcctggtacaagtacctgggctcttatggcaaggccatcgccatcgaccagttcggcctgcagggcgacggtgctcagaacatgatcgatctgggcatcaccgccgagcatgtcgtcgaagcagccaaggcctccatcgaagaggctcgctgattcatctatgaggggatgccatccggcatcccctcccctttgcctacactggtaggcgttggattttttcaacaacacaaattaggagatacataatgactgcatctactcaggcaatttccgatgccggcgtttccatctggctggatgacctgtcccgcacccgcattgagtcgggaaatctcgaagagctcatcaagaacgataacgttgttggcgtcaccaccaacccgtccatcttccagaaggctctgagccaggtcggcccgtacgacgcacagctcaaggaactcggcaaggtcgatgtcgagaccgccatccgcgagctcaccaccaccgacgtgcgcaatgcctgcgatatcttcaagccggtcgccgaggcctccgactacgtcaatggccgtgtctccatcgaagtcgatccgcgcctcgcacacgagaccgccgagaccgagaagcaggctgaggaactctgggccaaggtcgaccgtccgaatgccatgatcaagatccctgcgaccctcgagggcctgccggcgatcaccgctaccctggccaagggcatctccgtcaacgtcacgctgatcttctcgctcgagcgctacgagcaggtcatcgacgccttcatcgaaggcatggttcaggccgacgccaatggcaaggatctgtccaagatggcttccgtcgcatccttcttcgtctcccgtgtcgataccgcggtcgacaagaagctcgaggagattggctccctcgaggccaagggtctcgaaggcaaggccgctgtggccaacgctcgcctcgcatacgagctcttcgagaagaagttcgccgaggatccgcgctgggctgctctggaagccaagggcgccaagaagcagcgtccgctgtgggcctccaccggcaccaagaacgccgcttactccgacgtcaagtatgtcgatgagctcgtcgccaaggacgtcgtcaacacgatgcctgagaagaccctgctcgctgtggccgatcacggccaggccacgctgggcatcatcccgggcaactatgacgaagcccacgacatcatgaacgacctcgccgaggttggcatcaacttcaaggatgtcaccgacaagctcgaggccgatggtgtcgccgccttcatcaagtcctgggattcggtgctcaccgatgtccagtccggcatcgaccgtgtcaacggctgatttcgactgacttggtctagtcaagacataatcggatgggcccagcattcgctgggcccattttctatatgcatcgaaggcaatcgatcactgtgtgcggatgccgatgcttcgtgcgaacacctcggaaaggtcggcgatctgctccaaagacatggtggtcccatgcagtgaatcgacattgcgaatctcccgtagccgcgcgccacgcaaatccacatcggcacatatggcatgctgcaaggagagcacgtctattcgtgtcccagcgaatgcgatgcgcgagaacttggcatcgttgccgtccagctcccctatctcgcaatcgcggaacatgatgtcacggcatatggcatctctgcaattgagatagtcgatgcggcatccacgaatctccatgccaatgatcttcgccgtgttcgcctgaacggcaccgaaggagcagtggaccgcaatgctgttttccatgccgatgctgcggatgccgagcaacgcagtgcggcaggaatccacaagcacatgattaacatgtgtgcgctcggcaatgattgtgtcaattgcgagattcctgaactcgcaattgagcaacgcagcggcggtcatatcgatcgtggaggcctgctggtcgaagaagcggcgtgaatcctgatcgtcctcggcagtaagcaacgagagccgcgattcaatgagcccttccccgcccatcgggaatttgggaaggcggggaggctgagtgtcacgaatggctgccatggtgagagtccacagattcactcggcagatgcaatgattcgaggaacgcctcgatacgtgagcaggcctctttgatgttctccatgctcgttgcatacgaaatgcgtacgaagccttccccggaatcgccgaaggcagtgccggggacgatggccaccttgtgctcctccagcaggcgcacgcagaactcgtctgaggtgaggcctgaggatgtgatgttcgtgaacacgtagaacgtgcctttcggtacattcgtcgtcagtcccatacggttgagcctggcacagatgaggttgcgccgcgattcatattccctgcgcatcgactcggtatcggcaatgccgtgttcaagcgcctcaatcgccgcatactgtgccgatgtgggtgcggacatgatgacgaactggtgcactttggtgagctgttggctcagatccgcgttgctcagcaggtaaccgaggcgccaaccggtcatggcgaaggcctttgaaaagccgttgatgacgagcacctgatcgcgaatctgctcgaagttggcaggtgagcagaattctccctcgaacagcagttcggaatagatctcgtcggagatgacgtagattccggattccttgaggattggaaccacacgctcgtagtcctcgcgggtcatcacgccaccggtcgggttcgacgggaagttgagaatgattgccttggtatggtcgttgatcgcgcgttcgaggtcctccggcagtaatttgaaatcgttgtcttgcgtgagctcaatacgcactggcaccccacccgccatcaggatcgccggctcataagccacgtagttcgggtccagcacaatcacctcgtcgccgggactgatcaacgtccggcaacatagatccaccgcttccgaaccaccgacagtcacgagaatctcggattgcgggtcgtagtcgatgccgtagcggctgtggtaataccctgcgatttgcttgcgcagggcgatgagtccccggttcgcggtgtagtgcgtatggccgtcttcgaaggactccactgctttcgcgctgatatgccacggtgtgtcgaagtccggctcccccacaccgagcgagatcacaccctccatggagttcgccagatcgaagtatttgcgaatgccgctcggtttgagatgcgcgatggtctggttgatcggcttcatcagtagctcaccaccagacggtcctcggcacggttcggccgaccggcgccggtgagtatgccggattgtttgtactgcttgagcacgaacaacgttttcgtgctctgcacgttctccatgacggcgatgcgatcggccacaaattggcacacttcgaacatcgtcttgccctgcaccaggcagatgaagtcgttgtcgccggtgatcaggtagagcgaatcaatctcggggtattttgcgagcaacgccgcggtatggtcgtagcccttgcctttcatcgggctgacttccacctcaatgaacgccatgatgcgttcgtcacgcagcaccttgttgtagttgatcaccgtatggtaaccgcagatgatcttctgctcctccatgcggcggacggcctgctgcacctcttgtgcctcctcgcccagaatgtccgccagatcccgtgcatcgagccgcgcatcgttctcgagcagttcgagtatcgcctgatcgttcgcgctgatgttcccctcggccatgtctcctgtcatcctttccgcattccctgttgttcgccaagccatgcatgcgcctattggcgatagtggctgaagaagtgtgtcattttgtcgacggcgcctttgagcacctcgacgcgcggcaggtagaccacacggaaatggtccgggtccttccaattgaaaccggtgccctgcacgatgagcagtttctcgtcgtgcagcagatcgagcgcgaattgctcgtcgttgcgaatgttgaatttcttcgcatcgattttcgggaagatgtagaaggccgccttcggtttgaccgccgtgatgccatcgattgagttcagcgcgttgtagatgtattcacgctgttcgtatatacggccccccggaacgaggtagtcgttgacactctgatggcctcccaatgccgtctgcacgattgattgggcgggtacattcgagcagatgcgcatgttcgtgagcatgtcaaggccttcgatgtaatccttcgcgatcgacttgttgcctgacaggatcatccagccgatgcggtacccggcgatcatatgagacttcgacaaaccgctataggtcacgcagaacaggtcgggggcgagggaggcgattgacgtgtgggtgagcccatccatgacgaggcggtcatagatctcgtcggagaagatcataagctggtgctgccgcgccagttcgacgatctgctgcagcacctcggtcggatagagcgcgcctgtcggattgttcgggttgatgatgacgattgccttggtgcgatcggtgatcttggcacgcatatcgtcgatgtccggataccactccgactgttcgtcgcagacgtaatgcactggtttgccgcctgccagggtgacgcatgccgtccacaacggatagtcgggggccggtagcagcacttcgtccccgtcgtccaacaacgcactcatgctgaggttgatgagctcgctcacaccgttgccagtgtagatgtcttctactcccacattcggcaggttcttgagctgagcgtactgcatgatcgccttacgggctgagaagagcccctttgacgccgaatacccttccgtatcggtgagctgttgtgccatgtcatagacgacttcgtccggtgtacggaatccgaatggggctggattgcctatattgagtttcatcacatgcatgccggctgcttccatgcgcgccgcctcgttgaccaccggtccgcgtacgtcatagagcacgttgtccagtttatgtgacttggtgaagacccgtcgggagccgatgttcatgggttccgatgtgacacttgatggcacatcagggaacgaggggtcctgcacattattgttcgctgccgcttccatgtcttgctcctgttcaatttcagcgagttcattgttatgttcaatatgttcagaattctgaatcgaactattctgttcaactctcttgatatgttcaaaatcggcgtctggactcacgtgttcaatctttgcgaaggtttcaggatcatcgtcgaacggcacgctctcgcctgccagccaatccgcgttcacccgcaacacagccgcgaggaatcgctcaatatcgcggcgcggtcttgttttgccgctcacatattgactgatgtggctgcgccccagcttgactccatggtcctgcgccgctttgacgaagtcgatctgcttgatgttgcgcaactccatcgcctgattgaggcgcgtggtgaaatcggtcatgccgtccctccgttgaacttagaacataagtgtttcttcgaagcgtaccgtaacggttgaacatagttttgacttgaacatttcagtgttcaaaatacagaagttcaagatcaatttatgaatatgcggtgttcaatccatttcgccacgccgtcatcgttattcgaagcacatatctcatcggctatgttcaatactttcggattcgaattggcgacggccactccggttcccgcacgctgcatcatgtcaatgtcgatgatgtcatcgccaaatgcgaccacattgttcaaatcgatgttccagcggtcgcacagcagttccatggtgtactgtttgttcgcatgtggatccatgagcatccacagacttccctcgctgatgttgagcgacagttcgtcaggaagcaatgtgctgagcaacggagtctgctcgttggttgggaagatgatgatcttgtctgcggtgccctctgggacgtcggtgaaatcggtgaatcgccacgtctgtgtcttccagtacttagacacatcgaaattcgtatatcgtacgtcatccatgacgatgcctatctcgatgtcgggaatcacatgcgcgattgatcggcacacctcgcaggcatagtctgaagagaagcctattttcaacagttgcccgttgggagtagatttggttccggtgagcatcgcgtaatcagaggtcgccggatggaagtcgatgagtgcgccattgagatagatgcatgcatcggcatgcaatcggcgtaccatgtcgagacctgtgctgactggacgtgcggtggccacgacaaacggaacatggttgcgatgcaatgtgtcaacagtgtgaatcgtgtagtccgacaatgcgcgttgttcgaaggtcttgccgtcatggagcaatgtgccgtccagatcggcgacaatgaatggttccgtcaagtccactcccctgttcgtggatcatatgctgttgtataacaaaaacgaaaggacccatgccctcctagggaggagcatgggtcctttcacaaactcatatcaggcgacaccgaacttggtgaacagtccgagcgcaatgatgatggcaacccagatgagtgcgatgatcacagtccaacggttcaggttcttctcggcaacgccagaggaaccggcgttctgcgtaaggccgccgccgaacatgtcggacaggccgccgcccttgcctttgtgcatgaggatgagcagggtaagcagcagactgagcacaaccagcacaatctgcagaatcagcttgactacagtcacgggtgaacctccaaatttcaataccgttgtccagtgtaccgcaagttcgcgaaaaagcgtgcaaaatcaactattatcatgtgaagatgttgtcgcaatcgtcttcctgcagattgtggtgagctcatcgacgtcgagggcggcacctccgatgaggaagccgtcgacgtccggctcctcaatcagctccacacagttcttcgaagacaccgagcctccatacagtacacgcacggtctgcgccacatggtcgccgaatgatttcgccagatccacgcggaaggcatgggcggcgtcctgcgctgtctgcggtgtagcaaccatgcccgtgccaatcgcccagacgggttcataggcgatgatgagttttgatgcctccccatcggaaaggtcgcgtgtcacgtcatgcacctgtccgacggcaaactcaagttcaatgccctttcgcctctcctccagactctcgccgacgcataggattggctgcatgccggcggcaagcaccgctcgtacctgatcgacgatgttcgcatcgtcctccggatggtatttgcgccgttccgaatggcctacaatcacatagctgcaacccagatgcgcgagcatgtccgcagagacgtcaccggtgaacgccccctgtgacgtgaccgaaacggcctgggccccgtatctgatgcgcaagtgttcggattccaccatcacctgaacgctacgaatcgaggtgaatgacgggaagagcgccacttcgcaacgattgaagtcaaaatggcatcgtttgaggttcttggagaatgcccggacgaactcggtcgcctcaagatgatcgaagttcatcttccaattgcccgcaaccatggggatgcgtcgtgtcgatgccatattgccttgcctgtcctccatatgagaacgtggcgcccagtacctattgccgggcgccacgtcacaccgttattgggctagtgttgtgaatccctactcgaggaccttgaggccaggaagctccttgccctcgaggaattcgagagaggcgccgccgcccgtggagatgtgcgagaagccatcttcggggaatccgagctgacgcacggccgcagcggaatcaccaccgccgacgatggtgaaggcaccatgttcggtggcatccaccagagcctgggcgacggccttggtgcctgccgcgaaggcaggaacctcgaagacgcccatcgggccgttccatacgaccgtcttggaatcgacgatcttgtcgtggaacagcttgcatgactcaggtccgatgtcgaggcccatcatgtcagacggaatctgatcggcgggaaccaccttcggatcgaccggagtgtcaccagccgggaagcccttgttcacgacgatgtcaacgggaagcaccagttcgacgccgttcttgtcggcggtttcgatgtagcccttgacctggtcgatcatatcctcttccagcagggaggtaccgacttcgtaacccttggccttgaggaaggtgaacaccatgccgccgccaatgacgagacgatcggccttgtcgagaaggttctcgatcactccgagcttatcggagaccttggagccaccgagcacaacggtgaacggacgttccggatcctcggtcgccttggagagggcgttgacttccttctccaccagcaagccagcggcggccggcaggtcggcagcgacatcgtaatcggaaccctgtgcgcgatgaaccacaccaaagccgtcggagacgaacacatcgccgagagccgcaagcttcttggcgtatgcggcacgctcggcctcgtccttgctggtctcctcagggttgaaacgaacgttttccagcagcacaacgtcgccgtccttcatggcggctaccttagcctgggcgtcctcgccataggtgtcggaggcgagaaccacaggaacaccgagaagttcgctcaagcgtgcagccacgggagccaaggaaagctccggaacaaccttgcccttcgggcggccgagatgggccatgagaatgaccttggcgccttccttgcgcagagcctcgatggtaggcagcgccgccttgatacgaccatcgtcggtgatcgtagtcccatccagcggaacgttgaaatctgcgcgaaccagaacgcgcttgcccttcagatctccaagatccttgagtgtcttcattcgttatcctttctaaccgcaagaatgcgggtgtggcttatgccatcccttgcattctagcgtcaaatccacgcgatatcggttcgattatccgttacgcaacatcacgccttacaccagcttacgccattgcggcgtcctgctccgctttctccgcccgttgcagcagacgacggatgcgacctgccaccgcgtccttgctgatttgcgggcgtgcggctcgtccgagctcctccaaggagaaatcggggtgatcgatgcgcaattgcccggcggcacgaagattctgcggaatatcgtctccgagcacatcgaatgcatgctgcactttcaccacggcctcggcggcggctttcgcactgcgtcgcatatttgcgtcatcgaagtttgccagtcggttggcgcgatggtgtgattcggtgtcgggtctcttgccggtccaatcgcgtacggtgcttgaggctcccatcatcgtgaggagccgttcgatggcatccgggtcggagagatggacgcgtacggaactgcgcaccgtatgctttgcggctcgtatgccgaggcgctgacccatggcgatgagcgaatccgctgtctcctcgttcggacagataatctcaagcgcgctgggtttgtcgggatccgaaagcacaccagcagacatgaaggcaccgcgccacacacccttgatttgggcaatgttgccgttggacagatccgttggcagtccgcggacgatacggttgagccgtgggtctatcatgccggtgcgcaccgccaatgcgaaaccggcgcgtgcgccgacgtccacggcatatcgacgcatggagccctgaggggtcttcacatcgacggatttgagggcggctgggattttatacaggctctcgattgtttcctggagccagtgggcggcttccatggagtcgaattgtggttggacgatgatctgcgtcgaggattcacgctgcaccttgcggaatcctcggccgaagtacagcatcgacgtcacctgtgccttctgcaccgccggggatcccccatcgatgttcgacaactcgcttttgacctcatcgagaagcgccaaaagatcctcctgtaagttgtgtggtacctattacggttcggcgtgtctcattgactccgctgttctgtgataccgaacgtcttggacatctttgttgagttttcccacatgttgaagttgctttcacgatatgggaaaccacttgcaatcattgggttttccgatccaactctcgggccgagacggagaccgagaggccatgcgaccgcaatcttgatgccaatgcctcgctcatcgccacggaacgatgctggccgccggtgcaaccgattgcgatcgtcacataatgcttgtcctcctgtgcatagccttggatcgctatttcgatggccttctcataggcatcgaggaactgtgtggccttgtcattcgacagcacgtattcgctcaccggtgcatcatgtccgttgagctctcgtagctgtggcacccagtagggattgggcaggaaccgcacatcggccacgaaatcggcatcgatcggtatgccgtacttgaaaccgaaactgaagatgtgcacggaaacggttgtgggtccgttgcctgtcaaagcctcgtaaagcttggtggagagctggtggatgctcagtttcgaggtgttgatcacgatgtcggcacgttcctcgaggttctcgagcagtctccgctcttcgtggatgccgtcgataagacggttaccctgctgcaaagggtgcggccggcggacggattcgaatcgcttgaccaatacgttgtcatcggcatctaggaagaggatgcgcgttttgaggcccagatcatccagatgcgagagcaccgaactcaggtccatgaaatagtcgcgggagcgcacgtcgatcactgctgcaagcttatgaaacccggatttcgacgcagtcatcatgtccaccatgggttcgaggagtttgggtggcatgttgtctaccacataccaccccatgtcctctatgctatgggctgcgtgcgaacgaccggcgccgctcatgccggtgatgagcagcacttcaaagccttccgtaggagaggctgcatgcggtgattctggtcccgtgcctctttgttcattgcgtgcggactgcatcacaactccttctccaacgcttcccacatggcctgttccagtgtaccggtttggggtggattattcagggcatcatccacatcggcacccccgattattcccgtcatcagcaacacttgcgccacggcctgatgtagcagcatccgctctcctcctatggtgaggccgccacgatcgcgccaggccaccatgagttcggtcggacggggatcgtatacgacatcgagcaatgccccatggatgggttgtgcatgctccgcgaaatgccgggcaaccacatcggcgcccgttccgggaatcgtactgatggcgatgttgcattgttccagtgctggaaggcaatcctccaaggagatgctacgaaccgtcacaccatgcgcggcacccagctcgatcagtgccgtgctgcgattcggatgccgtgcggcgacagtgatctgggaacagcccatcgtgatgcacgccgccaatgccgaagtcgcggtgttgccgttgccgagtatgactgcgtgtggttgagctggcaacgtcatgacatgggtgcgaaaggcatcatggaaagcacgcacaataccatagacatcagtgttgtaaagtgccatggccggaagatcccgacccgctgaggtcgagggggaatcccaatcgaacacgacggtgttggcgacgccaagctcccgtgcccattggttccgtgcgataccgaagggggcgatggtgcgtttgagcggcatcgtcaggctcaagcctcgccaggaggggtccagggaggcgaggaatgagggaagttcgctttcagccacttcctgcttcgtatacgaccattgtccaagacccagcgctcgatacgcagcctcatgcaacaccggtgacagcgaatgtgcgattggtttgcctaataccgcacatcgttgcatctcattcatattctcatcccctcatttgtgcatgcccgttgcatgccctacagcactctacagcataactatgctttattgcggcatcggcgcatgccacaacacgactcatagccattgcaatagcgcatataagtggtcacgaagcattgtcatgcagtgcttcgtagatggcccgtgctttggcgtggccaacgcctttcacggattccagttcttcgaggctggcttgtctcatgcggcgcactgacccgaagtggtttagcagccgtttttggaacgttgggccgattcccggaatctcatcgagtgccgaacggagggcacccttgcgtctggtctgacgatggtagttgatggcgaaccgatgtgattcatcgcggacacgttgaagcaggtacatgccctccgatgaacgtttgagaatgactggatagtcgtcgtccggcacccacacctcttccatgcgcttggctaggccacacacggccacatcagtcacaccgcagtcctccaatgctttcgcggcggccatcacctgaggcttgccgccatcgaccaccaccagattcggtttgtaggcgaaatgacggcgatcggtgttctgctggactatttcctgttggacctgctcggcggattcaagctctccctcctgcgaagcccgcttctcgttgtccatgctttcgccggtgtctcccgcaatgttcccatgcttgaatcgtctggtcagcgtctcatacagcgcattgagatcgtccaccgcaccttttccgtcggcaccacgtatggcaaagcgtcggtattcggatttccgggccatgccgtcttcgaacaccaccatggatgccacttggaacgccccgcccaccgtattcgagatgtcatagcattcgatgcgcaacggcgcctggctgagtccaagcgcatcggccacatcgttcatggcggtcgtacgcgcacttatgtcggagatgcggctcattttcgaacgttgcaacgcctgctgtgcgttctgttcggcgcgttcgagcagttgcctcttgttaccccttgcaggcgtcccaatcgagaccgcgccaccgcgaagccgtcgcaagtattgttccaggtcatcggcacgcgcaggcatcaccgacaccagcacctgtctgggcacaggggcgatcggttcgagcagatcggcacgaccagtatgctcgcgtcttgcgttacgtgccttggtcgactgtgcgcgggatgacgcgtcgccggccgacatgcgctgtgtcgatcccatggccgtgcgctgttcctcgactttgatctgtgctttttccatgcgaatgggcgtgggttccgcgctcacggccgcgtcaagcgtcgctgcctgggctattggcggttccacggtgggtctggaggatggtggtgcatcagtcctgcggaattcccccgcttcacgctcactgtacagttccgaatacacctgcatgatcagatcgctgatcagttcagcgtcatcgacatcttcgatgcgttccacactccagttgcgttcgcctcgaatcgagcccgagcgcacgaagaatgcatgcactgacgcctcaagttcatcggatgcaatgccgaacacatcggcatccacatcctgatcgagaacaaccgcattctgctccacaaccgtggagagcatctggatctcatctctaaggcgcgcggctttttcgaaatcgagttcggcgcttgcctccttcatagccgcagtgagtttcgccacatacgatttgcctatgcctccggtaagcacgccgaccaattgctcacacaggcgcttgtggtcctgtggggttatgcgccccacgcagggggcagagcatttgcctatcgacgccaacaggcatggcctattggtgagttgcgccttgcggaaattcgcatcggtgcacgtgcgcaccgggaaggtgcgtagaagtccgtcgagacttttgcgcagatcccacactttcgcatatggcccatagtagcgggtgtcacggcgcttgcggctgcgcgtgacccaaatacgcgggtactcctcgcctatcgacagcgccagatatgggtaggtcttgtcgtccctgaactgcacgttgaaccgtggatcaaactctttgatccaggtgtactccagtgtgagcgcctccaattcggtgcccaccaccgtccattccaaggatcgggctgtgagcaccatggtctgggtgcgcgggtgcagctgccgcaatggctggaaatagttggatagacggttgcgcaggttcttggccttgcccacatagatcacctgcccgtcgccatcgcgccacttatagacgccgggctgggcaggaatgtcacccgtcttgggtctgaagagatcacgggagtcgccgagcagcggtgcgccgttcgcattcacgtcctctggcggctgtgcatgaccgccggcaccggtattgccggtgacttccatgagatcatcggcaagatgcctccaggttcctggcgcatggcgctcgaaaataggcatgtctccccttatcgcttgttgccgtgagtgattgccgacagtgcgtgaggtgtggcaatgtgttattggtgcatgtcgctcgatgcccgttcgagcatcggtgcaaggaatctgcctgtccaagacctttcgcatgtgaccagatgctctggcgttccctcggcgacgatcgtgccgcctccatcgccgccctcgggaccaaggtcgatgatccagtcgcaggacttcaccacatcgaggttgtgctcgatgatgatcaccgtgttacctttgtcgacgagtccctgcagcaccagcagcaacttgtttacgtcttcgaagtgcaggccagtggttggttcgtcgagaatgtagaccgtcttgccggtggaacgtcgttgcagctcggtggccagcttcacgcgttgggattcgccacccgacaacgtggtggctggctgtccgagacggatataccccagtccgacgtccaccagtgtgtcaaggtagcgtgagatggaggggtacgccttgaagaacttggcggcctcgctgatcggcatgtcgaggatgtcgctgacggtcttgccgttgtacttcacctcgagtgtttcgcgattatagcgtttgccgtggcattcctcgcattccacatagacatccggaaggaagttcatctcgatcttcaaggtgccgtcaccgtgacaggcttcgcaacggccgcccttgacgttgaaggagaaccgtccgggaccgtagccacgaacctgcgcctcgggagtcttggcgaacagggcgcggattttatcccatacgccggtgtaggtcgccggattcgaacggggggtgcgtccgatcgggttctggtctacatgaatcaccttgtcgcactggtccacaccctcgacacgcgtatgcttgccgggcacgatgcgggcaccgttgagcttgtcggccagcaccgggtagagaatctgattcacgagcgtcgatttgccggatccggagacgccggtcacgcaggtcatcacgccgaggggaaacctgacgtcgatgttcttcagattgttctcacgggcgcccaccaccttcagcatacgtgaacgatctatcttgcgccgtgtcttcggcacttcgatgctgcgacgccccgcaatgtagtcgccggtgatcgacctcggcgcgtcgacaaggtgttcggcggggccggaatacacgacctccccgccttgttcgccggccttcgggccgatgtccaccacccaatcggcgcttgtgatcgtatcctcatcatgttcgaccaccacgagtgtgttgccgaggtcgcgaagatgatgcaatgtggagatgagccgggcgttgtctcgctgatgcaggccgattgacggctcgtcgagtacgtacatgacgcccacgagtccggagccgatttgggtcgccagtcgaatgcgctgggcttcgcctccagacagcgttttggcggcacgggaaagagtgaggtagttcaggccgacatcgttgaggaatccgaggcgtgctcgaatctccttgaccacctcacccgcaattttcgccgcagctccggtcagtgagaggttgttgatccattcgaggctgcgctcggccgccatgtcacacacatcggcgattgattccccgtcgacggtgatggccagcacctccggtcgaagtcgcttgccatggcaggcgctgcagggcacttcgcgcatgtacgattcatagtattgtttgcgttgttcggaatcggtctcctcgtgccgccgcatgagggatcgtatcacaccttcgaagccggtggtgtactcgcgcatacgtccccaccggttacgatacgagacctcaaccttgaagtcgcggccgtataggattgactggcgcacctcctcggggaggtccttccatggggtatcgagactgaaccccatctgatcggcgagtccttcaagcaggtggcggtaatagtcgccgctgctcttcgtcatcatccaaggttctatagctccctcgttcaacgtcttgtcggggtcgggaacaacgagttcggggtcgatctccaagctgaaaccgagacccgtgcattccggacatgcaccatagggcgcattgaacgagaacgtgcgcggctcgatctcgtcgagatcgagggtatggccattcgggcaggccatatgctcggagaacggcacctgccttttcggatcgtcctgcggcaggtcgacgaattcggcgaccatcaccccatgggccaatcgcagcgcagtctcgacggaatccgtaagacgctggcgaatgccgtcacgaatcaccaaacggtcgatgacaaccgagatcgtatgcttcttctgcttagtcagcgtgatgtcgtcggacagctgccgcatctcgccgtctatgatggccctcgcgtacccatcgccacgcagcagttcaagcagatcggtgaattccccttttcgccctcgcacaactggcgccagaatctggaagcgggttcgctcggggtatgcgagcagtgcatccaccatctgctggggggtctgggcctgcactggttcgccgcacaccgggcagtgcggtatgccggttctggcgaacagcagacgcaggtaatcgtagatctcggtaatcgttcccaccgtggaacgtgggttgcggttggtcgttttctggtcgatggagaccgccgggctcagaccctcgatgaaatcgacatccggtttgtccatctgcccgaggaactggcgggcataggcggaaagcgattcgacatacctgcgctggccctccgcgaacaacgtgtcgaaagccatcgatgacttgccggaccccgacaggcctgtgaacacgaccatgcggtttcgggggaattccagatccacatccttgaggttgtgctcgcgggcaccctgcaccatgattttgagatcattgggcaagtggccgatgtcggccaccagattgccatcgtgttcctcgaggggcgccttgccgagctccctgctcaggaacgagtcgctcgtcatcaccttttccacgaccgttttcctgctcgcccgtgcatcatgatttgccaaggcattcctcccgtcaggcatcgctctttccacgccgtctgtatgcgatcggcttatgtgtatgcagtatcgtacatcaattccacacaaaagtcgaacacttgttcgattgtgggacgtgtgccgcagccacccaaataacaacatatgccgtcgccccatattccatcgtcgggttttcccggttgactgaattcgatgctcatgccgaacatgtgcgccagctggcgatatcgtagagtcatacacatgcattcactcgtatctgggagagctgatgggcgagaagagacagacagagcatacgcaggccaatgcggtgaccgtggagccgaaaagcagttcgcagcgttcaaaacagaaggtgcggcatgacattgagatgatctgtgcgtgggtgtcgttcgccgcattggtcgtgtgcaacgtgctggcacagaccggggtgatgggccgtatggtcaagccgcagcattcggaggcgttcacttggttcgtgccggcgcgatatacggatctcatctgggcggtcatattcgtattcgccgccgtttggcttgtgcgtctcggcaacgataagcaccgcgcgaggaatctgggcaagatcccggccagtctcctcggaatcctgttcattgccgcctgtgtactgcagattgcgtggctgttctgcttccatgccgtgaactacccggccacgatcacgttggtgtttgcctcgaccatagtgatctgggtgctatggttcttctcccggagacatgacagaacgctatggggctgggtgccgttctcgctttggggttcatggctgggaatcgagaccatcaccgacatcgcccgcgcagtgagctactacctgtccaaagacggttcgctttctgcgttcggacagatgatttccactatcatcctggctttgctgttgctggccgtcgcctgcgccatgcgctggtacatgggtgattgggtgttcgggctgtgcgtgttgtggtccgtgctcggagtggcgattcgaatcatggacacttcgaagatcaccgcggtgattgtcatcatcgccgagagcatcgccgccgcactcatgtatctgccatggcgtcatctgaccggaaggctcaattccgtggacgcgctctcctcggcacatgcgggtgcggtggatgagcaaggacggaagagcgtggaatccgacggagaaccgcaatcgacggattacccaggcgcccaggagcataggtgaggctttcatcacgccgtctgtgagtcagcgcagccgcgtaccggaatttcccgggtacgcggctgttgtgtatgaggtgagcactatggaacgattcattcatgtggagcacggtttcggaccctgctatgcggcggattctacccgcttgttccttggcaccatggcgagcccgaaatcacgggaagccggcttcttctacatgcatccgcgcaaccggttctggccgatcatgcaggcgttgttcgccgatccgcaagatgcctccgacgtggttggcgacactccggattcgcgccgggcattcgcgctgcgtcaccggttcgcgttgtgggacaccgtggaatcatgcgatatcgtcggcgccagcgattcgagcatccgcaacgtcgtgcccagcgacttgagcgagatcattcgcaattcacagatctcgcatatctacgcgtgcgggcagaaggcggaccagctgttccacaaatacagcgagccgatgctcgagtgcaatggcatccatgtatctgaaacggctcttccctccacttcccccgcatatgcatcgaagacactcgaccaacttgtcgacatatatcgagagcgcattttcgactgattccggttcatctgccggttgacgacgtaggaataagaagacccaaggagcctgatatgctcaacgccctttgccatgtccacgacgattcctcgccgctgttcctcatgttccacgggtacggaaacgacgagcatgaaatgatccgcgtcattgaggccgttggcaggcacgacccgatgagctacatcagtttccgcgccccattcgagcgcgaatacatgggcggctattcgtggtacccgcatggatgcggccccgaggcgcgcagacggttggcagatgaaagcatcgggggaatcaggcggttgctcgactcccccatctgccgcaatcgtccaaccgtctgcatcgggttctcccaaggtggctatatgagtctacgtatggtgcttgcggagcccacgatgttcgatgccgccatattgatgagcccctccttcgtcggcggattatccgatgacgagcgagagcggctcatgcacagccgtacacgtttcttactatgctatggcgaggatgacacgacgattccgcgggccgaccaatgcaggctccgcgaatgcctgcagcggaccggcaggctgacataccgggactacccgcagacggcgcatgcgatcgtcgccccggagatacaagacatacgagagttcatacaggagatggtgacccatgccgattgacgcgcagggacttgagattcagatcggtgcccgcacgctgctgcacccgacgaacttccatgtgacgaagggtgacaagatcggcctggtgggccgaaacggcgcaggcaagaccacactcacccgcgtcatcaccggagacatgctccccaccgcgggcaccgttcgtgtctcgggcaaactcggctaccttccgcaggacacccatgccgccgatccggaacagacggcgctcgaccgtatgatgagcgcacgtgacatcgcctcgatcatcaaacgaatccgcaaggccgagaaggagatgaccagcccggatcccgacgtgatgacgaaggcgatgaaccggtacgacaaggcgatgcaggatttcgagaaagccggcgggtatgcggcgcaatcggaggcgaccgcaatggccgccagcctcggcctaccccaggaggtcatgggccaacaactcggcacgctctccggcggacaacgccggcgcatagaactggcacgcatcctcttctccgatgccgacacactcatcctggacgaaccgacgaaccatctggatgccgattccatactgtggttgcgcgaattcctgaagaaatacgaaggcggattcctcgtgatctcccactccaacgaactgctcgacgaggtggtgaacaaagtatggcacctcgacgcccagctcggccagatcgacatgtactcgctcggttggaaggcatacctacaccagcgcgtcgtggacgaggagcgccgtcgccgtgagcgtgaagtggctgagaagaaggccgagcgcctcatgcagcagggcattcgactgcatgccaaagccacaaaagccgtggcagcgcagaacatgatgcgtcgggctgaacgtctcctcgccgaaacctccgtggcccagaagaaggagaaggtggccgacatacgcttcccggagccggcaccatgcggcaagacccccatcgaggcgaaggacatctcgaaagcctatggctcgaacatcgtattcgcgggagtcaatctggccatcgacaaaggctcccgggtggtcatcctcgggtacaacggtgcgggcaagaccaccacactgcgtttgctcgcccatctcgaggagccggacaccggcgtggtcgaatatggccatggcgcgaaaattggctatttcgcccaggagcacgacaccctggatctaggcatcaccgtgctcgagaatctgcagcgagtggcacccgaactcaccgacacccaagcgcgctccatactcggatcgttcctgttctccggtgacgatgccttcaaacccacccacgtgctttcgggcggcgagaagaccagactggcgctcgccacgttggtgacctcccgtgccaatgtgctgctgctcgacgaacccacgaacaatctcgatcccgcctcgcgcaatgagattctcaaggcaatctcgaaatacgagggagcgattgtgctggtcacccacgatgagggcgccgtcgaggcgctccgaccagagcgcgtgctgctcatgccggatggtgacgaggatctgtggaacgattcgtatctagagcttgtcgccgaggagtgaaggcgatgggatgtgttgcggcgttgtttgcgtgcgcaatcaggattcgaatatcatagtggcccggacgaaagttcgggccactatgatattcgaggaacgagattgctattccatgagatcaaccggttcgtccggcgtccctgcctgcgtctctcgcatcatatcgggttccacatagatttcccagttataccatggcatcgcggtacgcaccgcatcctcgatcttgttcaccgtcgtcacatcgtaatcacggtcgaacttggaggtctgcactttgaggcagagcagaatgttgtcttccgacatatgcacgctctgcatgttgaggagatcctccacgccctcggtcccctcgaccgctttgatgatccgctcctgcgtcaacgggctcaccgactcccctatgagcagcgaaccggtcttgtaggcgaggagcagcgaaccgacaatcaacacgatgcctacgaacatgccgccaagcgcatcgtacagttcgtcaccggtgcagatcgcgagtcctatgccgaggaaggcgaacaccagaccgatcaatgcgagcgtgtcttccatgatcaccgaggcgaggtcggcggatttcgtcactctccagaaccgatagatgcccatatgcggcataccggtatgccgcatgcgttcattggactctttgaccgactggtgcagaccatacccctcaaggcaggcgctgatgaccacgacgatcagcgcaaccacgagctcaccccggttcgccactcgtgccgactgatcggagagcacttcggtgatcttcttgacggcctcgcttgtcgagaagaagccgcccacgaagaacagcaaggttgccacgacgaacgatgccaagtatttgacgcggaaccaaccaaaggggtgttgcgggttcttgcgtttcttgcgggccactcttccgccggccatcaatacgatctcattcgtgcagtccgctatcgaatgcaccgattcggagagcatggccgaggattgcgtgaatgcccaggccgcgagtttggcgatggccacgccgacattcgccgccaacgccgccttgacggctgcgccctcatgctttctctcttcctggacgattggattgtcctgtttgggtggaatatgccgaggttgtgccatatcggtctgcgtggatgtactcattgctcacttcttcactgattgcgaggtgtgggaccgcacgggcggttcggtcacactgtctgtttgtcactatgggccacttccgcaatggttttcacggcgttcatcgcgcgcggatacccgatgtacggcaggcattgcgaagccactgcaatgaggaaatgcgcggtgttgcccacccggaggttcgccatgatatggccgcgcagctcattggcgcaatccggttgtgccatgagcaggcagaatgcgatcatctcccgttcctgcaagctcagtccgttccgcgtgaggtaggcaccgaggtaatcgccgctgatccaggaatcgatgtgaccggcgcccatcttgcgaaactcctcgtcactgtctgcagattcgccgaaaagtgttctgcgcagtgaggcaccttcttgtgtgcggttttgcttatcgattgcggattgcggcgccaagggcagttccacattctccacattgagataatcattgattcgtttgagatacggcagtgtatgcgcgaagccgatcaaaggcgtggcctcatacacgatttccttgagttcaacggatgtgacgccggagtgatatgagataggcagcatcatctcgaaggcatccatgccctgtgcgccgatgatggctgcgatgatcgccatgcaacgggcatggtcgtcgagcttctcatcattggcaccgggctcattgaccaccgtgtcatatgcgaattcgctgaagatcccaatgaactcgggatccgtctcgttcagtgtgcgatcggcattccagaaccggttcatcttcctatgcagttcctcgaacatgccgttcctctgtcctttctcggcatagaaatcgggacccacgcatgcgcaggtcccgaatacgtgttgtcccagtctacgaggcaatcgttaccgaacggagtcctctggcgtcctcgctcacttgctctgcaactggttcgaggaggcgtcgaaatccttgacggcataggaatgcacggccatatcgtcgtacttcttcaaatacacggtttgcgtggccgttgaatagcagtcagaaaacagcgttttctcgaattcgccgttcgccgagattgcagtcccctcgatcactgcggcggtcgacaacgtcttgaataggcggttcacgttggcattctcgccgctctgcgtcggataatgcgtattgttgtatgccgcgcgcacgaagcgcgccatggaaccatagccacccggaagcccctgcgaactgttggaatcctgattggtctcaagttccgagcttccccatttcaccgacttgccggtacgcggggaaacgtaggcataattgtcgagatgctcgatctgctgtgggaacggtggctgattggtgagcacatcgacatcgtcatcgtagacgtgcatgccgtcctcggtgcattcgacgacgatgctgcgggtgttgtcggcgatgatccaatgcagtgtggccaccgggaacctgtcattgatgggcttgccgacgatcgtcacgttcttcagagcctcctgtacatcgtccacactggtgaagttgcgggtgacccacagggggaactcgtatgcggccacgttcgtggtgaagttgaccgcctcggtggcgtacttgcagtacttggcgaagttgagacccgccacggcgaggccggcatcgttcatgcagtcgaaatacagcggcgtatcttccacgatgatgccgatgccgatcaccgggtggttcttgtcttcggcattgaatgccggcgcgtaatggtaatcatgcggggcgaatacgattttctccccgtaatcctcgctccaatcgagattgcggccgaagtacatattgttctgtccatcgtcaaaacgaacggctgtgcacattgcagttccttccgatatgcccggcggtgaaatccgtatgggcgtcatgcccaattctatggacggggaattcgtccatgtcgatttttcgttgagaggtgaagcaaacaggttacgctatcgcccaatcatgcatgccgccttgcgccgcgtactagagttgagactattcgccgtcctgttttatggaccatacggaagggatgtcttatggcctcactgaccgctcaacgcgagcagaccgcagcgctcgatgacgcacacatcgatttactgaccaccaccgcctacagtgtggccaatgtgcgtgccatggagcaacccctgttggcgaagggcgtgcctctcatgcgcatggcggcacgcgccacggcgcacaagatcctgcagatcatagaagacgctccccttgacccgcatgacatacgggtcagcgtgcttgtcggcgcgggagacaacggtgcagatggcctgttcaccggtgccatgcttgcggcacagggcgtgaacgtgacggccattgccgtcggcaagcagctgcatgaacaggggttcgtcactttcgtgcagtccggcggccacatttggacgcttgatccgggttcacgcattcccggcgtacccaccggattctcctcgggagaggccgggcaacgacttgagacggccattcgctacgccaaacgctcccatatcatcgttgatgcaatgaccggcataggcgtacgcgatgccctgcagggcattccccgcgcactcgcagaggtgcttggcgccttcaagcccgacgagggtagcgaacacaagccgttggtggttgcggtcgatacgccctcgggcataggcgtggatgatggcacattgccgggtgcctacattcccgcggacatcacgatgatgttcggtgcactgaagccctgcgccatgctcccccctgccgcatacgcctgcggtgagatcaatctggtggatttcggcttcgacctcgaatccgcggtgcctggcgttgagatggtggatgccgatttcgcccgcatgtcgattcatgagccgaaggtgaccgactcgaaatacacgcgtggtgtggtggggctcatcaccggatcggtgcaataccccggtgccgcagtgctctccaccaccgcagctgcccgctcgaacataggcatggtgcgctacctcggcccacaacatgcccaggatctggtgttgcaggcattgcccgaagccacaatgggtaagggacgcgttgaagcctgggtggtgggcagtggtgttccgggggaagacacgcaggacattcaacgggaggccattgaatcgttgctggcacattatgaactcaccgatccggcaccggcggaatcggtgagcgacattgatggcggtgatgtggaatacagcgatgcccagcagaacgaggaggccagaaacatgcctccgatcgtggtggatgccggagcccttgacttgctgccccgacatgtgccatcacaggtcgtgctcacgccccatgccaacgagctgtccagactcctgacgcgtatcgacgaaccggtgaatgcagctgagatagaacaacgccccctgtatttcgcacgacgtgcggcacgtctcaccggggccacagtgctgctcaagggtgcgttgaccattgtggttggacccgatgatgactcaatgggtcgcgtgctcgtgtctggccgggcgccagccaccctggccactgcaggggctggtgacgtgctcgcaggcatgaccggagcattgttggcccagcaaggtgacgcctatctcgaagatcccgccaccgttcccgaaacagctgccgcagccgcataccttcatggactggcggcctcgctggcctctcatgcaacccaacatgcttggaacaaaccgaacatcgtgggattggaagagaccgatgccgacgaatccctcggacgccccatcatcgcctccgacatcgtccgcgcggttccggaggcgttccgtcacttgggaagcatggaaggttgatccgcatgtgaggtacatcatatgtgacgttcgccgcattcgctctgagtagactcgcgtacaatccacgctgcatgtggccatactcgaagaaggatcttttggcaatccatcgaaaggaagatcaccatgtcaatgttgcagcataatctcatcgatttctccgtggaggcctaccatgacggggcacttgagaccataggcaaggaggatctactcggtcattggtcggtgctgttcttctaccctgccgacttttccttcgtctgccccactgagcttgaggacctgcaggatcattacgccgagttcaagaaggccggttgtgagatctactcggtgtcgtgcgacacccagtgggtgcacaaggcttggcatgatgccaatgagaagatcggcaaggtgcagtacccgatgctcgccgacaccaccggcaagctcgcccgtgatctggagacctataacgaggagtccggcttggccgaacgcggcgatttcatcatcgaccccgagggcaaggtggtggcctatgaggtcatctcttcgaacgtcgggcgcaatgcagaggagatcctgcgccgtgtgaaggcgtcgcagttcgtgtacgagcatggcgatcaggtatgcccggccaagtgggagcccggcgacgaaacgctcgagccgagcctcgacctcgtgggcgaactctgatcggaagcgtattggagcatggacgattcgaaactctatgacgcgattgtgatcggtgggggccctgcaggcctcaccgccggcatgtacctcgcgcgtgcacgttaccgcaccctcgtcattgagaaagaggacttcggcggtcagatcaccattacggcggaagtggtcaattaccctggtgtaccgcgcaccaatggccatgcactcacgaaggcgatgcgccaacaggcgcaggatttcggtgccgaactcaccgttggcgatgtcaccggcatcgaggaggatccagaccgttccggtttgaagatcgtgcatacgaagcgaggcgattaccggtgcttcgcggtcattctggccatgggggccgctccgcgcaaaatcggtttcgacggtgaactcgaatatgccggtcgaggagtcgcctattgcgccacttgtgatggcgagttcttcaccggcaaggacgtcattgtggtcggaggcggtttcgccgcagctgaggagtcggtgttcctcacccgcttcgcacgcaaggtgacgttgctggtgcgtgaggacgacttcacctgcgatgccatggtggcacagaaggccaaggacaacccgaacatcgagattcactatggcaccgagctcgtcggggtgcaggccggtgagcaaggactcgacagggccgtgtggcgttcggtcgccaccggtacgcaaaccgtctggcagccagacgatggaggcaccttcggcgtgttcgtattcgccggatatgtgccacagaccgctgtggtgaaaggagtcgtcgaccttgatccgcagggatatgtgattgccgacgaacatatgcagaccagccggccgggcatattcgccgcaggcgatcttcgggtgaaggatctgcgccaggtcgtcacggcaaccgccgatggtgccatcgccgcggtgaatgcggaacggtatgctgccgcgaaaagtctggagacaggcatcgtgccgaaacgtgtggatcatagtgtctatgagcaggaggagcagcaggctgcgcggaacaagcctgcgggcaccacccctgccccggctccggaccgcagccagtcggaagatccgcagaacacggtgtccgcggtgttcaatgacgacgtgatcaaacaactcaatgtggtcttctcgcgcatggcgcggccgctgacattgcagctgcagctcgacgagacgaagacctcatccgatctcaaggcgttcatcactgaactggtgcgcctgagcgacggcaagctcgacatgatcgaagacaaggtgggcaagatcgcccccaacgggcgtggcgaattcgatgtgaacgattcactgccgtttgccgcccctctggtcagcatcatggtgcgtgacgatgcggggatgctggtgcctaccggcttgacattccacggcgtgccgaccggccacgagttccattcgttcgtgcttggcctctacaatgcggcaggccccggccagccactcatcggagacgaggctgaacgaatcgatgcgattcacgatcccaccgagatcatgatcctggtgagtctgacgtgcacgatgtgcccggagacggttcgtgcctcccagcgcatcgcagcggcgaacccgaatgtcagggccgaagcctacgacgtcgcccacttcccagaactcaaggagaagtatgacgtcatgagcgtgccgtgcatcgtactcaatcgcggaggcagacaaaccgtcgagttcggcaagaagaacgtcagtcagatgctcgatctgatcgacgcactgtgagtgatccgtaaccgaaagcacgtcgcgggcgcatatgtttgctcatatgcgcccgcgacgtgctttcggtgtgggcgaagtaggcaggtgtcaatctgaaatgattgtatacccgtggttcgcaatgacttccttgagcttgtcgagataggtctgtgcggccttcgagagtttcgcgcgttcgttcgtgatccagcccagcagcatcgtctcgtcggtgtcgagcggaatcgtcatgatcttctcattattgaggtcgccattatcgattccggtgcacaccgtgtacccgttgagcccgatgatgaagttcagaatggtcgcacggtcggtcacattgatctgcttgggcgaatactccggccacaccgcctcttcggcgaagaagaaggagccctcctccccctgctcgtactggatgaacgggaagggcttgagatcgtccatcgtcactttcttcttcatcgacagcgggttgtctttcgagatgaacacgtgcaatggcgcgcggaaaagcgggtggaactcgaggtgcttctctcgcagcatcttgccgatcacatgcgtgttgtagtcggaaaggtacagaatgccgatctcggaacgcatgttcgcgacctgattgatgatgtccttcgttcgtgtctcgcgaatggtgaactcgtattcatccgatttgaacgagttgatcatctcgacgaaggcctcgaccgcgaacatgtaatgctgtgtggagacggagcacagctgcttgcgcggtttcgcgttcttgtaccgttcctccaacagatccgcctggtcgagcacctgccgcgcataggtgaggaattccgcgccgtcgacggtcagcgcaatgccctgcgaggagcgcgtgaagatctctatgccgagctcgttctcgagttccttgaccgacgagctcaacgcaggttgcgaaacatacagtgcgtgcgacgcctcgttcatcgacccgcattcgacaatcttgacgatgtaccgcagctgcaacagtgtcatgtgattctccccgaggttgttgtcaacgagtagtgtaccgcccgggaatcgcccgtccaaacggttgctcagtgttcgagcgaaagcaggtcacgtctcgcctgtgctacgtcgctgaatctgaatgcatgccagcccacggatttcgcgccgtccacgttgcgctgcgtgtcgtcgaagaacacggtggtctgcggttccagattgaagcgggactgtgcaagctcgtagatgtcggcgttcggcttgcgcagtttctctatgccagacaccacggttccactcagcaatcgttggagctgcgggtacttctcgaacgcgaaatggaatgtgtccgccgaccagttcgtcagtccccagacatgcactccttgttcgcacagttcggtgagcagttcctcggcgccgtcgaccaattgcggcaacgcatcgccataatgctcgatgtaataacggtacacttcggcgatctcgtcaccctgctccgcacgcaccagttcgagcacatccgcgaaatccgcgccaccgtccatgagatcctcgtaatggaagaaaccatacggatcgttgtccgcacagatgtccgctaccagctgctcggggtacactccgtcgagcgccgcatggcattgccagtcgatcagcacgccgcagaaatcaaagacgacgtcgctcaccgccctgttcgtcgtctggttctcgcccatgttcgcctcttcctgcaattactgcaatcggttcctgcgtcagtataattcaagcattaccgatatgcccgtaattcccatacctcgatcaaccctagggagagctaggcgacgacacactgacgagtggagtggatttacacggatgcaccggccatatatggtcgacgcatggggtattcggacgagacgagtgccagcgaggcacgagggctgcaacgagagcgacgcgacttagaggttcaacgctgtgcagccgccgaggatgtgtgcgggcggcaggtggcatgcgtcttcgcgctcacgacggcattggcgctcatggggttggattggactccactcacgactggggtgacaagacggcgtttgagacctgaatatctacaggttgtggtgggtccgtcggatctcaagccagaagacagaatcgccagcaaacggcatggaagggtttacggtcggttcagcgtcacctacttcaaaagcggaattcctctgaagacgatcgaagtcgccccaggtgtcacctgcacctcatgcgcattcacctggctgatgttcgcccaatggctggatttggaggagttggtgaagctcggcgatgccatgatgcgtcggtacacacttcacgagatgatgaccatacaggatttcgtcgatttcctcgattgggtagatgagtatgccagacgtaatcataggtatgctccacgaggcattatgaaatgccggaaggcgttgccgctgatggcacaaggtaccgattcggttgcggaaactatgttgcgtttgatactgattcgctatggcctgccaatcccttgcgtcaattaccaactcgtcttgcgcgatggttcactggtgtttctggaccttgcctaccctgaggcgaagatcgacatcgaatacgatgggcgtcatcatcgctaccaatgggcacgggatgcccagcggaccatgaagatccgtgccgagggatgggaatatttccaggttacctctgagatgctctccgatgatgagcaaatgtttatggtggtcgtgctcgttgcccggtgcctcaaggaacgaaccggcaaggattacctgctgccgcagccattgactttggagcaggcggccgaccaacgccgcgcggtctggcatggttgatttcggatttatcggccgtcattcgtctctgttttgcggaaaagtggaggtcccctccataacatcttggtttcaagagcggcaaaactcgaccacctccacgtagcgggattcggaatatccggttttccgctacccttgggcaccgctacttgtgggcttggcattttgccgctcttgaaaccaagatgtgcgcggtccggcgattgccaccgcctctcttccgataattgttccgcgaccgtcaccaaatgccgtgactggttcgcacggattagacgcttcgctcaggtatatgcttgatgtatttgcttattcaacgtacgcttccggtcggtggaagcccacatatcgttcaaggaatgctggcaatggacgcattcgacaagatcgtgcagaggagctcatgagtcagatggaggatggaatgaccggcatattcggcgcgatcataggcgatatcgtcggctcgaaatacgaagccaatccaatcaaaaccaagcatttcccgctgttctccaatggttgccgattcaccgacgacacggtgatgacctgcgcggtagccgagggcatcatgaatggtggtagcgcagatgatttcattgatgcgatgaagaaatatgggcgcatgtacccgaacgcgggttatggtccccggttcatgcgctggctgttctccgacagtcgtgagcccatcggcagtttcggcaacggatcggccatgcgcatatcgccttgtgcgtggatgatgagctgcggattcaccgcacggaccggattcatgcccatcggaggtcgcgaactcgccgagcgctcgatcacggtgacccacgacgatcccgaaggtgtcagaggagggatggcagtggccgactcaatcttcctcgcgcgatactacttcggcggctgccgcggtgagcatgagaggtctctggccgacgatcctgccgcatgcagacaacggatcgaagaccacatcatccacgaatacgggtataacatgagccgatcactgggcaaaatccgttcagactaccggttcgacgccacatgccaaggttcggtgccagaggccatcacctgtttcctggaaagcaccggtttcgaggatgccatacgcaatgcggtctcattgggaggagacagcgatacgcaggcagccatagctgcgagcattgcacaggccgcctatggcattcccgacagcatagccgaacaggcgctctcctatctgcccatgcccttgcgtgacgtgctgacccgctgggatgcattctatagagaccttgacgagccgccgctctttttcgaacatcgcccgtacaacgcatgaaaatcgaatgtggacgtcacaagagaatgctccactgctctcgtcgcaggaaagtatgaattgtgtggtgatgatttggagggttttaggttcagttgaatagtaagttttgaaacttactattcgtaaggttgttatattccgttactttcatctgttacactaccgccatggaaaaactcgatatcttcgcaaaggactgccccgcacgcttcccgctgcaggtgatcagcggcaaatggggactgctcgtcatcctggccctcgagaagaaaccgctgcgtttcagtgaattggtgcataacatcggcggcatcagcgagcgtatggcttcgcagacgctcaagtacctggagcagattggcgtggttcgtcgtgaggtgctgcagcgttcgaagccgccgcaggtctattatgagttgacgtcgttgggtcggcggtttctcaagccgcttggcgagctggtcgagacggtgagtgcgcatgtggatacgatggcgtatcgccgtggctgattccgtatgactgtgcgtgcgaatcggatcccaaatcatgtccgcgatgccaatcattgcatttcatttcatcgcatctcatcgacgtgaaaaggacatgctgacgctggaggtgtctcctcttgcgtcttggagagagcgtgccagtcaattggcgatgctcgtacaatcatggaggtggtatgactgaggaaccattgagtcttgagctcgaagatgccgaatggccgttcgaatatattgatcatgatcggccaatcgcgcgggccatcgtcatcgatgctcacgcgtacttctattttctgcgggtgcagcgtaccgacgtcttcggcaatgcggtgacgatcgaaacctccggaggcggcatcgaaccaggtgagactcccacggaggcggtgatgcgcgaggttagggaggagcttggagctgagattgagattctcggcgagattggcttggtcagcgattgctataatcggattcaccgccataatatcaatcactactacctgtgccaggcgctttcgttcggcgagacgaatctgacggagctggagcggacgagattcaatctgtcgacattgaagctcacctatgctcaggccatcgccgaatacaggagatgcgaggattccaagctcggcagactgattgcggcgcgtgagctgccaatgctggagcgagcatggggcatgctcggaaagttgggatattagtgagattcaggtgtcgatgcgcgtgagttcggcgagcgccttgttgcggtaggtcaggtcgtcgcgcgatgtgaatccgagccgctgccagaacgcgttgccatccgcgttgcgggcgaagacgacgagcgccaccttggcgatcccctcgtcggtgagcgcatgtaacgccgcttcgacgagcgcggtgccgatgccctggtggcggtggtcgggactgaccgcggtgtggtagatgtatccgcgccgtccatcgtgcccggcgatgatgacgccggtgatgcgcccgtcacgctcgtccacgaagcatgtggtcgggttgcgtgccagatatttggcgatgccgtcgcgtgagtcgtcgatggtgttgagccccatgccggtgcatgacatacagcatgcgcagacggcatcgtagtcgtcgatcgtcattggtcggatcataggcgttctttccgtatctcttccggttttgttgttctgaagcgaagcatatgaccgaaggaaacccgttctatttcttcctgatgagtctcagtgtgaggttttctgtcactgtcgctgcggccgatatcaccatacttcctccaatgatgggccgcaatatacttccagtttttgggcgtatcccagctgcgggtgcagattcgtggacggcctattggatgttaggcgcggattgtcgccgccatacccgcatctaggcatatgtgtgccgatggacttcgatgatgccaccgtgcattgatcatcgacattgttcttccgagaggaactgcgtcttggaatgcttgcaagggagcctgtatttcacctgataggcttatgcttgtgccaagcgtaaccaccacacctccttcctcatgcaatgcatgaaaagtgggcaacgaggagacctgttgcccactgaaaatgatgacagcccactcacgccccgtactgcgtcagatactcctcggcggccttggcgatctcgtcggtgacgtagggctggccgtgctcgccgatcagctgccgtccggcggcgaagatctccttgacgttcgcaatggcgaacacggggaacccgaactcgcgttgcacgtcctgcacggcggagagatctgagtccttcgtcttctccatgcggtcgacggagaggacgaggcccacgatgttgacgtcggcctgcgccttgagcttggggacgacctcgcgcactgcggtgccggcggtcatcacatcgtcgacgagcagcacgttcatgccgtcctcgagtggcttgcccaccatcgtgccaccgtcgccgtggtctttcttctctttgcggtcgaaggtgtagccgatggaggcgttgaagcggtgctgcatggcgatcgtggtggccacggccagcgggatgcctttgtatgccggtccgaacacggtgtcgatgcgggcggccaggttgcttgcggcgatctcctgttggatcttctcggcatagaattcaccgagcgtggcgatcttcgcaccgtcatcgaaggcgccggcgttgatgaaatagggcgactggcgtcccgacttcaatgtgaacgagccgaacttcaacgcctgcgattcgagcagaaactgggtgaaacgggtatccaatgcttcggtcatctgtgggttctcccctctggtaaacggatgcgcgaataatctgcgtattcgggacatctccgggttcgatttgtcccgaatacgccgattgacggtcatgaatggaatcggaacggcgaacgggcatcgccgacgggtcagcgccaggtgtcgcccttgacgagcttgtgtgccaattgcgggcgtgagtcgagcagatcgtcgagttcacgcgccacgcggatcggtgcggtcgggtcgtagagcgcggcgccgcccacctcgacggcgttggcgcctgcatacaggtattcgagcgccttctcgccggagtcgatgccgccgatgccgatgatcggcacatcgggcagagcggtgcgcacacgccacacgcaggccagacccaccgggaacacggcaggtccggagacaccgccggtacggttcgcgatgatcggttcgccggttttgatattgatgcgcatgccgaccagcgtgttgatcatgctcagcgcatcggcaccggattcgacagccgccttggcgatggccgtgatatcggtgacattcggcgtgagcttgacgatcatcggcttgtcggtcatcgggcgcaaacgctccatgagccggctcaacgccatcggatcggtgcccacgctcatgccgccgtgggtcacgttcgggcagctcacgttgatttcgagcatgtcggcatccgagtcggcgagcttggcgacaacctgggcgtagtcgtcgtcgcaatgaccggccacattagagacgaccgtggcgcccatgttcttgagtttgggcaggtcatattcgaggtaatggtcgacgcccgggttctgcaggccgacggcgttcaccgtgccggccgggcattccgccgtgcgcacaccgggattgccaagccatggcaccggcgagacgcctttcgtggtgacggcgccgagctggctcacatcgtagaactggccgcaggcgtccacctggaacgtgccagaggcggtgcccaccgggttcctccatggtatgcctgcaaccacggtgccatgcttccactcatgcggttcgtacacactgcttgtggtctcgttcatcgtctcgttctccttcgcccgctcgtccatatcacgcatcggcgttcgcctcggcaccatcggcgtcccaacccaattggtgcgcagtgaagaccggaccagcctcacacaccttctcgcggccggcacgtgtgtcgattgtgcaggccacacaggtgccatacccgcatcccatgcgctgctccatgctcagttgggcgtccacgccacgtttggaggcccaagtggccacggctctcatcattggcgtcggaccgcaggacagaatgatcgtcttgcgcccgctctcctccaatgccggccacagacgttcgagcaacgtgagcacattgccctccgactcgtcgatgctgtgcacttcgtccgcgtacttggcagcatagatgtcggcgaaatgctcgtcacgatagccgaacacggcgatcgcccgcgaatccgcctcatcacgcaggctctgcgcggcctcgagcagcggcggaatgccgagacccccgccgacgagcacataatccgcagcctcatcgagattgaagggcgtgcccaacgggccaagcacatcgatggtgtcccccgctgtcagcttgctgaactcgtcggtgccgaaaccgaccaccgcgaagatgaggctcacctcgtcgccatccacctcgctgactccgaaaggacgtggcatgaggtgcatggggttcgacgaatacagattcacgaactgcgcaggtcgaacatggtgggcgatgtattcgtcacggaaggtaagacggacgatgcccgcagtgagttgcttcacggcgacaatgctgacggtgcgcctggtcggggtgaaaccggcctcctgggcctgttccaccgtgcgggtgaatgcggttggcatgaatctccttggttgttcggtgtgcgagaatccgtacggacggctatcgcatacaaatctatatcggttatgcaagggcgacgcgcagctggtctcgcatatcggccgccgctgcgcgggcgttgacggctacgagttccagcgcggattccggttcgagtgaatcgctgtattgctcgtcgttacgccaggcgcctatgatgccgcgggatgagttcacaatggcgccggaaccgttgtggtcgaacatgccggccacgctttgtgccgtgccgccctgtgccccgtacccgggcacgaggaagaacgtgtggggcatgcgctcgcgcaatgcggcaccctccttgggatgcgtcgcaccgaccacggctccggcccgggaatagccgaaacggccgatggaatccttgccccaatcctccaccagatcggccacatgctcatacacccggccgccatcggccaattcgagctcctgaatctgcgagctcgacggattcgaggtgcgcaccagaatgaacatgtcgcgatcggcttgcccggcggcctccatgaacggttcgatgccgtcggaacccaggtacgggttcaccgtcaccgcgtcctcaaaccacacgtcatcgccttggaaaccggtgagatgatgcgcgtaggcggcggcggtcgaacctatgtcaccgcgcttgacatcgccgatcacgtacaggccgcggctttgcgcatattcgcatgtcatcgtgtaacagtcgatgcctgcgggcccgagcgcctcatacatggcgatctgcggcttcactgcaggcacgatgtcgtacaccgcatcgatgatggcgcgattgaattcgaaatacgctgctgcggcagcggtggctgccagattgtcgtccgactccacctgttcctcggcttcgacggcataggcatccatcacgggggcgggaacgagtttgtcggtggggtcaaggcccacgacactgggattctgtttgtcttcgattgcttcgatgagccggtccataatcgctactcccctgtttccgtttcggttgcctcgtcaaatcccagtcggtcgaacaccagagcggatgcgatgatcgtcgcatacggcttgccgctcacatcccagccgttgaatggcgtgttacgtgccttcgacaggaaccggcccgcgtcgatgctccactgctccgtggtgttgagaatgttcaggtccacgagctccgggtgttccacttcggccaggttcagcgagcgcttcaccgcgcatttcgacgaggtgttgagcaatgcggcgatgtcggtggaatgccgtcccatcagttgggccggattcagcgacatgagctcgatgagtcgctggtcgctgatgtggccgccgtcgacgagtaccttgtggcataccgcataggcgcattccagtccgatgatgccgttgggtgcttcgaggaatccgcgggccttctcttcgagtgtgtgcggggcatggtcggtggcgatcatgtccacggtgccgtcctcgatcgctttgatcgtggccaagcgatcccgttcgccgcgcagtggtgggttcatcttcgcgagcgtgccgtattcgagcagcgcctcgtcgttcaatgccagataatgcggtgcggtttcgcaggtgatgggcagcccttcggccttcgcgttgcgaatggcgtcgaaggagattgcggtggacacgtgctggaagtgcacgtgcacgccggtttcgcgcacgaggtcgatgtcacgttgcacgatcgccagttcggtgtcttcggggattcccggcacgttcagggcatgggatacgggaccttcgttcacggcgcccacgtcatggtgttcgcagtgctcgatgaggtatagtccggtgctcttgacgttgtcgaacacctggcgcagcactggttctggcacggctgaaccgtcgtcgctcattgcggtgacggggtgggcgatctgtgcggggtctttctcactgtcatggcccggcatgtaccatgcccagtccttcgggtcggtcggttcgagcccggcccggcctttggtggcgcatacgcacagttcgtagcgtaccggcagcgtgacgtggtggatctgttcatagtgctgcagataatcgatcaccgtgtggtagccggcatcgagaatctcctgcgcgccgggttccccctcgtgtacttgaaggccgtccatcgccggcacggtgttcggcatgatgagcacgttcgtgtaaccgcccgatgcggcggccatgcatccggagaccatcgactccttgtaggtctgcccgggatcgcggaagtgcacgtgcggatcttcgaagcccggcgccacggtgagcgcactggcgtcgatggtgacgtcacgcgggtcggggacggtcaggtcgatgtgttcgcccgtgtcccacaccgtgatgtcggtgaatgtgatggccatttagaatttcgcctcctcgtcgcagtatcggcagcggtacacctcgtcgtcggtgtggtcgaggtagaacacctggtcgatgccgggttcggtggtcgtcacgcagcgcgggttcacgcaggtgatcacattgaccacgcgttcaggcagcgtcggcgtctgtttgttcacaatctggccgccgtggatgatgtcgacggtggcttggcgggccaccagtccgagcacgtcgaggtcgacgtcctgggcgtcctcgatcttgatgatgtctttcgaaccgtaccgtcggctcgttgtgttcatgatcagcgcgagcttcgtggtggccgggtcgatgcgcaggtattcgagcaccttgagcgcggtgccggcaggcacatgatcgatgatgatcccatcctggatgctagtgacttccatcaggcttcgacctcctggttcgcatactgctcgtagccgggcaattcgtcgccgagcaccgagctttccaatgccatgcgcatgagcatgccgttcttcacctgttcgaaataggcggcacgggggtcgacgtccacctccgtggcgatttcgttgacgcgcggcaacgggtgcagcaccgccatcgtgggtttggccttcgcgagtttgccctcgtcaagaatgtaggtgtcacgcaggcgcaggtaatcgtcttcgttgaagaagcgttccttctgcacgcgcgtcatgtacagggcgtccagatcccctatgaccgtactcaagtcggtgacctcctcgtacgagcaggtgggcgtggcgttgatgcggttgagcacgtattgcggggtgcgcagctccttcggtgagatgagcacgaaacgcacgttgccgaagcggcacagcgtctcgatgagcgagtgcacggtgcggccgaaggtcaggtcgccgcacaggccgatcgtcaggccgttcacccgtccgaatcgcgactgcagtgtcgcgagatcggcgagcgtctgcgtcgggtgcatgtggccgccgtcgccggcgttgatcaccggcaccgaggaggcgtccgcggccaccagggcggcgccttccttcgggtgacggatcgccacgacgtcgacgtagttcgacacggtcttcaacgtgtccgaaatcgattcgcccttcgttgcggagctcagctgcgatcccgcaaaaccgatcaccttgccgcccaaccgcagcattgcggtctcgaagctcagtcgcgtgcgcgtgcttggctcataaaacaaagtggccaacacccgtccgtcacaggtgtgtgccacttccttgcgatgcgaatcgatgtactgcgctttatgcagcaactcctcgatttgcgtgactgtgagatcgtcgagggtgatgacgctggttcccactatggactgtccgtcggcgtgttgctgaacgctagacaatggctcacctttcatgcatgtgctgttccaggtgatcaccgaagtgacctctccaactataccccactgccccgccggctcgacacgccctcataattccggctgcacataccggggagccttggcatgggccgccttcacgcgcctggcatcagcctgtgcagaacgggcgcctgcaactgcgtcccgggccggatgattcgtcagatccctgtcgatccaagccatgacgagatcggccagtctgttcacctcggcatcggtcaacggccgacctttggcaatgccatgccatttctcgatgcatccgcggcagcatgtcgccgtcgcatgctgggcggtgaacaccgggtgcccgcgccaaggcgtctgcctgccgtcgttggacggttgcgcctcgcccacgcgtgcgcgcagcatctcatgcgcatgcctgtcgatgacatgtctgcccttgtcgcgcgcatacgaccgatcagcctcgctcaacacgaacttcgcacggaactgcgattcgccgagccgcacgagggtgtgctccacccacgtggattcgtcatcatgcccattcatacccgccagcgtatctcactcctcaacaccgtagaagagccgttcgcatacttcacgactcttgcgcatttgcgagagaatgtcgttctcgaactgctgaccgcgatccggatcgtagccaagatacgtggcaatgccactcaggtcgaaatgctggtcgggcaggatgtcggcgcggttcgcccgcccgttccacagatagttgccgttgcgcgccgctgtgcacatctgccaggcgtcacgcagtatcttcgcgtcctccatgacgatgagcccatgctccaccaagacgtcaagggcctgcatcgtcgaattcacctgcaacgcctcaatgtcatgcgcatgctgcaattgcagcaactgcacggtccattcgacatccgacaggcctcccctgccgagtttgagatgccggtcgcgtcgcacaccacgtggcagacgctccgcctccatacgcgccttgagtctgcgtatctcctgcaactggtcgtcggtgagacgctcggctgggtatcggaacgggttcgcgacattcgccagaaagtcctcggccagctccttgtcgccggctgcgaatcgggcgcgcaacagcgcctggcgctcccacacgcttgcccatgcacggtagtactcctcacacgaggcgtacgagcgcacgacgggcccgttcttgccctcagggcgcaggtccatgtcgagttcgatcttcggttctgtcgacaccggacccatgagcatcatgcgcatctgctcctgcaccttgcgggcgaacgaattcgcggcggaatcgtcagcgccgtgcgcaggacggtagatgatgatgacgtcggcgtcggagctgaaattgacctcacggccgccataacgccccatgccgatgacggcgagatgcgcagccggtccatccatgccgttcgcccgcatcgtatcatgcaccgcccattgcagcgaggcctggatgatcgagtcaaccacgtcggtcataccattcagggcctgcgccgaatcgatcacatcggtcatccagccgatcccgatgcgctcgatctcatggcggcgcagtgcacgcagcatgttcgccgcgtcggccagtgaatcatcatatcgtgtgatgatcgcctgacagcccacatccaacgattcacgtgtgcgcgcatgcaattggtcgtcatcgccgagccagcggatcgactcctgcgacttgttgagcgcgtcgccgaggaatctggaattcgacagcacgtgacacaaccgctgtgcggccgactgcgagtcgcgcaggaaccccaggtagtcgctgccggaaccgaaccgttcctcgaggttgctccagcccagcagtcccatgtcggggttctgcccttcaccgagccagcgcagcaccgcggggagcagtatgccattgatcttcgcggcacgggtgatgccggcggtgagcgcctgcacatgccgcagcgccgcctgcgggtcggcgaaaccgatggcggcgtaacgatccatcaccgcctgctcgctcagttccacgcgttcgtcgcccgagaccgcgctgatcggcagcatcggccggtagtagatttcgttgtggagccgacggatctgcctgcgtgtctcgtcgaaattgtccaccagctcctcgttgtgccagccgaacacgcgggcgagcctgtgcagttcggcattgcgcgagagctcctccacattgaccgtgcgcttcttctccaatccgccggcgttcgcattgcccatgtcggggaacagatgggtgcgtttgagctgccacatctgctggcggtgttcaagcacccgttcgaaacggtagtcgtgggagagcacgcgggcatggcggcgcgagacatagccgccatcggaaagcgcctgcaacgcctgcaacgtggagcgaacatgcagggtctcatcggcgcggccgtgcaccagctgcagcatctgcacggtgaactccacgtcgcgaagacctccgcggcccagcttgatctcacggtcgcgcaatggcactgggatgaggctctccacacgttcgcgcatgcgctggcagtcggagacgaagttctcgcgccgcgaggcctgccagacgaattcggatgccatctgcatgtatgcctcgccaagaggcacgtcaccggccacagcccttgccttgagcagtgcctggaactcccagctctccgcccactgccggtagtaggccttatgcgagtccagacggcgcaccagcggaccgtccttgccttcgggtctcaatgccccatcgatctgccacagtgcgggctccatcacattgggcatcaccgattggcagatcttctgcatgagcatggcgatcttcgaaccgaccttgaccagctgcggttgcgacatggtctcggccatcggctccaccacgtagatgagatcgacatcggagacgtagttgagctcctgtgcgccgagcttgcccatgccaatgattgtgaagcgcaggagttcggactcctccgtgttgctctgcgcaatggccagcgcgctttccagggcggcgtccgccagatccgacaacgcgcgggacaccgccggttgaatcgcgatcgggtcgtcgtgcgaaacatcgtaggccatgatcgcagccagttgttcgtaatagttccgtcgtaacctattggtcgcctccgccaacggcacgtcggtgatcaggcgccggaacgaggagtccgaagagtccgcggcgccgagctgctcttcatgggcatcgatcgccgccaacatggtcgcacgtctcgcctcgccgtcaaaccccgcgctgtggagggaatcgacagccgccgcctcgacgagttcgggtcgcgaccgcatgagcacgccaagttgccggctggcaccgagcacctgcagcaatgtgcgcggagacctaccgtgcagcagtccgtgcagttttccgggacggtcggcaaagctgatgatcagttcatgcaatgcgtccaatgccacgtccggatccgcgcaatgcgccagttcgccgagcagttcccgctgggtgagttcgagatcccccgccgagcacacctcgctgagcagttccttcgcacggccgagattctcgaatccggcatgaatgatgtctcgtgtgcttggggtggtgttctcgtcgatctccatgcctgtcaatctagcgtgtttttgttgcgctgggaaattgggtcacgctttttcgaacagattgcccacgttctgccatattctgcgcgagaccgacggatggttcatcgtgtacaggtgcacgccatcgactccctgagccacgaggtcgctgatctgctcgctcgcatagatgatgcccgcctcgcgtagcgtcctgggatcgtctccccacttttcgagcatgcgttcgagcttgcgcgggacccgggatgagcacatgttcgtcatgcgccgcaccgatttcgcattggtgaccggcatgatgcccgcctctatgggcacatcgatgcccgcggcccgtgctttgccgaggaatgcgatgaaatcgtcgtcgtcgtagaacagttgggagatcagatgcgaggcgcctgcatccaccttggctttgagattcgccacatcctcgtcgagcgtggccgcctgcgggtgcttctccggatagcaggcgccatagatcttcagattcggcctacgttcgcgaatgtaacacaccagatcactggcatgggtgaacacgccggccggttcgcgctcgctgttgcggtctccgcgcaatgcgagcacgccgctcactttcgcctcatcgaacatggcgagcgcctcgtcgacatcccgggcggtgaggtactgtgcggtcaggtgggcgaccgcgtctatgccgtattccgagtgtatggtgtgcgcgatgcgtgcggtggccgtgcggtccgctgatttgccggtgccgtaggtgaccgagatgaagtcgggtttcatgtcgttcagcccgtcgagggtgtcgtagatcgtgccgaccggcgatgtgcgtttgggtgggaatacttcaagggagaacattggcgtgtgcatttgctgggtctcgtgctgtgtgatgcgtgcattctgatgggatacgcagtatgtatgccacagtgggcggatatgccgccatggcatgcatactgcgattatggtgtcctgcggactgtttggaggagcccgaatcagtcgaggttggcgcgcatggctttcgccgcctggaccatgtgcgtcagactcggccaggtttcgtcattgcctcgggtcttgaggccgcaatcgggattgatccacaccttgttcacatccatcttcgcaagaatctcgccgatgcgctcctcggtctcttcgaccgaggggatgcgcggggaatggatgtcgtacacacccggaccggcctcggtttcgaagtgggcgtcgtggatggcgtcgagcaccaccagatcgccgcgggaggcttcgaatgagatgacatcggcatccatggcgtcgatgtccgagatgatgtcgttgaactccgaatagcacatatgcgtgtggatctgcgtgcttggctgcacggcggaatgcacgagacggaatgcgggaatcgcccagtcgaggtattcacgatgccagtcggattcacgcagcggcagtttctcacgcaaggcggcctcgtcgatctggatgatcctgatgccggctttctcgaggtcaaggacctcgtcccgaatcgccagggccaactgcttggtctgctcctcatgggtgatgtcctcacggggccacgaccagttgagaatggtgacagggccggtgagcatgcccttcatcggcttggcggtgcgcgattgggcataggagctccatgccacggtgatcggctgggcacggctcacatcgccccagatgatcggaggcttgacgcagcgggtgccgtaggactgcacccaggcgttcttcgtgaacaggaaaccgttgaggttctgaccgaagtattcgaccatgtcgttgcgctcaaactccccatgcaccagcacgtcgagtccgatctgctcctgcttggccaccacatcgtcgatctgacgtcgaatgaattcgtcgtattgcccctgggagatctcacccttgcgaaggcgggcgcgttcggcacgcacctgcttggtctgcgggaaagagcctatcgtcgtagtgggcagcaacggcaggccaagcgcctcacgctggagccgctggcgttcgccacgctcgggtcggcgcacatagtccgcatcggcaagggcggcgatgcgggcgcgcacaacttcgtcggcgaccacacggctgccatcgaacagcgcctggttggcggcgagcgcagtggactgacgcttcgcatcgtcgtcgagctgcatgaggtctgcgatctcgcgaacctcctcgagtttctccacagcgaaggcgaaatggcgcagcaccttgtcgccaagctgttcctcccccttggtgctgaacggcacatggagcagcgaacaggccgaagcgactgcgacgttggcggtcacctgctggagtgcctccaccagtgcgatgctttccgcatagttgttgcgccagatgttgcggccattgaccacgcctgcgaagagcgtggtgcgtgctgctacaccatggtgttcgacggccttgaggttctcgtcacgcccttcgatgaggtcgagtcccaccccgtcgaattcgaagagcttcactgtttcgtaaatatcggctatgttgccgaaatacgtgttgagcagcaccctgacaccgctgtcccgcgccggcagcagacgcgaatagagcgatttgaacagcgagacgtcaccctcgtgcttgtcgagcaccagatatggttcgtcgagctgcacccattgcgcgcccagcttggcgaagcgccggagaacctcggcgtacacgtcggccacggcatccacgagcccctcgtcgatggtgagctcctgggcctcggcatcgcgggagagtttgaggaaggtgtatgggccgatgagcaccggcttcgtctctatgcccagcgacttcgcctccaagtactcatcgaacggtttcgtgccgttgagccgcacctcggtggaggagtcgaattcgggcaccaggtaatggtagttcgtggtgaaccatttcttcatgggcaatgcggtcacatcgccacgctcaccctggtacccgcgggccatggcgaacagtgtctcctcagggttgtcaaaaccaagacgacggtatcgggccggaatcacattgagcaggaccgcggtgtcgagcatctggtcgtacagtgagaaatcgttactcgggatcagatcaatgcctgcgtccttttccaacctccaatgccgaacacgaagctcgcggccggtctcacgcacatcgtcgagcgtggcattgcctttccaataggcttcgatggccttcttgagttcacggtcgcgtccgatgcgggggaaacccgagatggatgtgggaatggtcatggatcctccagtcgtgtcgatgcaatggagaccacgttagcaaactggaaccggtgcaagcccgaaattcttaaaaacggcgcataggagttttctttcaaaggctataaggcacacttatagcctgccgtcgacgcctgcgcctgctacttttcgaactccttcggcgtgagcaccgcaatgagattcgcctcatgggtcccccattttctgaacggcgcattcgaaccgaatatcgccacgccggcagtcgacatgccaaggttcagcagatcgagctggcccggatcactttgttcgcctgccagccactggctcgccagcgagacggtgggctcatggccgagcaccagcagcgcatggcgtttgtccttgcaggcagcgagcatgtcgaacaccgcctgcatacctttcgcatagagatcctggtagtagtcgactttcggagcgtcgccgaacaccttgagcatgcgctcgcatgtctgcatcgcccgggtggcgcttgaacagtcgatctgatccggcaccaatcccatgtcgcgcagacccttcgccacgcgcttggcctgcttgagtcctttgtcggtgagcacacgctcaaaatcgcccttcgcgttgaaggcctccgtcttcgcatggcgcatgatgatgagcacgtgcttgtattccttggccctcttcgccactttcttcagattcacgcttcctccatgcatcccgccgggcctgaccgacccgcacccttcccattctaattccagccatgctgtagtgcatcgtgtcgcgcccggcgataatcggtcattgagaatccaaatgactgcgttgttcgtccagatccctgagcaccttgcgcagcttgcggtcggagatgtcacgaagctcaagctcctcgagcgatgcctcgcgctcctctacggagagtgagtcgatatccgtcgtcgtgtccttcgtggcacggtcacgcttgcgcaacgcatcgtatccgggagccatcgcccgggagacgatgaggaaaccggtgtggccgatcatctgatggtcgggacgcactgcaagaccctgcgctttccaattgcgctccatggtctcctggatctgcggtgcggtccaatgctcactctcccgcagcgcttcggccatacggctcatctgcgtggtcgtcgtcacataggcgacgagcacgccacctggcgcgatcacccgatacgcctgttccagtcggttccagggatcgagcatgtcgagcatgatgcggtcgaatccttgttccggcaacgtggaggccaccgaatcgaaatcgccgaccagaagattccaccaatccggtcggcgcccgtaatacaatgtggcgttcgcctcggcgatcctcgcgaaatcagggcgcatctcgatcgtggtcaggcagccgccctcacccaccgcgtcgagcaggtgcaggctcatcgcacccgaaccggccccggattccagcacgcgggcgcccgaacgtatgtcgccgagctcaatcacctgcgcgatgtccttcggatacatgatctgtgcgccacgcggcatcgacagaacatagtcggccatgcgcggccgcatcaccgcgaactgccagccgccgattgcgcgcgcagccttccatggtttcgccgtatcgcgttccgggtgctccctgttgaattggtcctcacgcttggcggtgacggtggtgaccacgctgccctcgttcctgccgatcacatcgtcatgcaggatgatgccatgtgaggtctgtgtgacgccgcccgcaaccaattggtcggtgatcttgttcgacttgcggtcggtgaactgcactttctcaccggattgcaacggacctctgcgcatacgctctcgactccatgctctgcttgctcattggacgtaaatccactgtagccaagctcgtctacaccatccgtcggccttcccgtcgccgacatgctcatattcgggcgaaggcgctccatcggtcgtcgatgtggtgcacgtcgagcggcatgccgaacagtcggctcagccgttcggcggtcaacccgtgttcgaggtcacccgcatattcgatcgttcccggtgctggatcggcagggtcgggttgcgacgtgacggttgactggcgtcccatgatcgcaatatggtcaaaaccctgagggatctcctcgagatgatgcgtgacgacgataatcgtacgtgggtcgtcatgcagcgacgacaacgcgcgaatcgtgatctcgcgcgcgccgagatcgagtccggttgtcggctcgtcgagaatgagcagttcggattgggccatgagcgcacgacagatcagtgtgcgtgtccgctccccctcggagagtcgaccgaactgcttgccggcaaggtatgcgatgccgaaatcttccatgagtctgcgcgcgcgggcgtattcgtcggatgtataggtgtccttccaacggccggtcgtcgcgctgagcgcggtgaccacgacgtcaagcgggtcttcgaacggcggaaacgcgcgcgacagctccgccgagctcagtccgatcaggtggcggtacgagaacacgtcgaccttgccaaggcgccgtccgagcacgtcgatgtcgccggatgtggggaacgcgcgtgtgctcatcatcgagatcaggctcgatttgccaatgccgttcggcccgaacagaatccatttctcgccgcgtccgatctccagattcacgtcatccacgatcacacggccataccgtcgcagatgcacgttgtgcatggccaacgcccgtgtttcgcagtccagtccttccattgcacccccatatgagagctggatcccgttgcatgggatccagcccgcttcctcttgcttgccgtgccgcgaattattcgtgctgcgccgcacgctcctcgagcacactgcggtacacggcgacggtctggtccgcgatcgactcccagctgaacttgtcgcgtgcgcgttcgcgcccacgttcacccatgtccttggcccgctgcgggtcggcgaacatctcattgatcgcatccgccagatcgtgcacgaaccgttcgggattcgtcggcgtgccggtgccgtcgtgcttctgttcgatgggcacgagatacccggtcaccccgtcgacgacgacctcaggaatgccacccgtcgcggtggcgaccaccggcagaccgcaagccatcgcctcgaggttcacaatgccgagcggctcgtagatgctcgggcagatgaacgcatcgcagccgtgttcgagcgcgttgagctcgtgcttcggcagcatctcctcgatccagatgatgttgccgcgctcctcattgagcctagccaccgcctccttgacctccttgccgatttccggggtgtcgggcgcgcccgcgcatagcaccacctggatgtccgggtcgacgaaatgcaatgcctgcagcaggtacggcagccccttctgccgggtgatgcgcccgacgaacagcagggtcggcttgtcgcggtcgatgtggtagcggtcgaacaccgcccagccggcatcatcgggggccggcgtctcgaaatcggcaagcgtgatgccgttgtgcaccacgaccaccttgttcgggtccacattcgggtaggcggcgagaatgtcctcacgcatgccgccggacacggcgatgatgcggtcggcatgctcataggcgtcacgttcggcccaggagctcagattgtagccgccgccgagctgctcgcgcttccatgggcggaatggttccagcgaatgggccgtgatcacgagcgggatgtcatgcagcagctgcgccatgcgcccggcaaggcatgtgtaccaggtgtgggcgtggacgagttcactgtcgacgtcgttggccatctgcagatccacaccgaaggttcggatggccgcgttgtcgccatccagctccgtcggcacatcatagcctatcacacgcaacgagccgcgtccgtcgtgctgcgccgcctcggattcgcgcggtccgtcgaatgcgcgcaccgtcacgtcgatgcgttcggccaacaccttcgccagctcctccacatgtacgccggcgccgccatagacatgcggcgggtattcgcgggtgagaatgtcaactttcataatcgcctcttccatgagttccatgcatacgactgcatacaccacaatacggccttcggaggcgagaaacacaatggattgtgtatattggaacgatccgttccgccggcgtcgcgaaccgcacaccgaagcagatggtcaacacgtcgctttttgcgtaattgattcatgggcgttcccccaacgcgcgaaaactactctattcgcgtatttgcctatacagacaccgggttcgggtctaggttggagacatgagtgaaaacaacattgtacgcctgaacaaaggcgataaggcaccgaatttcgaactcgaatcggacgaatacaagcactatgcgcttgcggacttcaagcaccagaacgtcgtgctctacttctacccgaaggcgggcacgtcggtgtgcacgcgtgaggccaaggacttccgcgacaacctcgagcgtttccaggccgaaggatatgccgtcatcggcatctcccccgacgatgtgaaggcgctgcaggagtttcgcaagagcaacgacctcaacttcatcctgctctccgacccggagttcaccgtgcacaagctgtacggcgccgccaaggagcacgagaaggacggcaaggaaacctacgagaccattcgttccactttcgtgctcgacggagacgacacgattcgcttcgccggctacgacgtgaacgtcaacggccagatcgacgaactgctcgagcagatcgagaagatcaagtaaggcatattcgttcccggaaggggtcgcgctcatcgccgcggccccttccttttgccccagccatcgcccctgcatgcgtctgatcagacggcggttccattctgatcgaggttcgggttgttcttcgaatcaccggccgtgaagaacaggctgatcacaccgcaggcgaagactgcacacaccgtgatgatcacccacatcggcaggttaggcacccacatgaccacgaagaacgagatggcggacaccacgatgacgatccagctgaacagacgcgcccattggcgcccggaatgtggggcacgaagcacctgtggcgggtcgtagttgtctggatccgtgtcgagcgcgatctcctcgtacttctcaagttcgctgctcgatggcttccacgggcccttcttgccctccttcagccgacgggaacgctcctgcaactgcgactcgtcgatcatgccactgcgaccacgaccctgtgtcgagtcatactgcgagggcattcccccgttgtttttcgaacgacgttgcgcacgattggccatgtcttctccttcgtaaaagtccaacacccatactctagcgcaccgagggcatgaaccagcgccgtccgtcgtgacttagcccgtagaagcgaaggcggtcccgacccgggaccgccttcgcttcgggggcttgctcctcttgatcagcggcgaggcagcgccatcgggcgctccgaggcgacaatgggggccggaagctcggtgcatccggtcagatacctgtcgacggccgcagcgcaggaacggccctcggcgatcgcccataccaccaggctctggccgcgtccggcatcaccgcacgagaacacgccatcctgcgaggtctggaatgcgtcgtcacgggcgacgttgccacgaccatcgaggtcgaccggcaactgcgcctgcagggtttcggtatctgggtgcaggaagccgaccgagatgagcaccaagtcggcggggatcacacgttcggtgcccggctggcgggtgaacgggccatccttgccgggggccaccgacacgaccttgaggccggtgacatgaccgtttccatcggagatgaagccctcggtctgtgtattgtcgctcaccgtgatcttggcggcgtcctcctcggaacccacgaagttcactgaatcggtgctgtagacgtattcgccgccctcctccatggaggaggtcttctggtagaggcgggcgaaggtcggccaaggctggttgtccgggcgcttcgtcggttcctgcggcatgatctgcaacaccgtcacatccttggccccctggcgaatcgaagtgcccaggcagtcggaaccggtatcgccgccgccgatgatcaccacatgcttgtccttggccgtgatgtcatggatcggctgcttgccgaacacacgacgggtcgcgtcgggcaggaactccatggcgaaatggatgccgtcgagatcgcggcccggaatgctcatatcgcgcggaacggttgatccgatggccaccactacggcgtcgaactggctgcgcagatcgtcccagccgaggtccttgccgatctcggtgttcgtgcggaagcgggtgccttcggcctccatctgtttgactcgacggtcaaggagccccttttcgagcttgaaattggggatgccgtagcgcatgaggccaccgacctcgtcgtcgcgttcgaacacgacgacggtgtgcccggcacgggtgagctgctgtgcacaggcgaggccggccggccccgagccgacgacggcgacggtctggtcactcagacgttcgggcggcagcggcttgacgtattcgagatcccacgcctggtcgatgatggtgacctcgtcgttcttgatcatcgtcggcggctggtggatgccgagcacgcacgccgattcgcacagcgccgggcatatgcgcccggtgacctccgggaagttgttcgtcatggacaggcgatggtaggcgtcctcccattgtccctgccgcaccagatcgttccattcggggatgatgttgcccagcgggcagcccgacatacagaacggggtgccgcaatccatgcatcgggcggcctgttcctgcgtccagtcctgcagaccggattccgcatgaacatcaagccaatccttgatgcgttcctcaacggggcgttcggccggttccctacgggacctcaccttcaggaatccacgtggatcacccatgtcagcgcgctccttccatcacgtgctcgtaagtttcctcccacacaccgggctcgttgaaatcgatgtgttccgccttggccttgtccatggcggcggtcatggcgacgaactgcttcggcacgaggtgcgtgaagcgcttcgccgactcactccagtgctccagcagctccttggcgaacacggagccggtctcggcggcatggcgctcgaccaattcgcgaacaacagccgaggcatgctcatcaagcggttcgatctgcagcgcgccggaggcggcctgggggttgagcttgtccctgtcaaggtcaagcacatacacatggcccccggagaagccggcgccgagattgcgcccagtggaaccgaggatcaccacggtgccgccggtcatgtactcgcagccatggtcgccgaccccttccaccacgaaggtggcgccaccgttgcgcacgccgaagcgttcgccggcacggccggccacgaacatctcgcccgaagtggcgccgaatcccagcacattacctgcgatcacattcgtatgcggatcgaaggtgatcgcgtcggtcggcctgatcaccatgcggccgccggacaggcccttgcccgcatagtcgttcgtctccccgacgatgcgaatcgtctcgccacgcggaatgaacgcgccgatggattggccgccggtgccgttgagcgtcaggtcgattgtgttgtcgggcagaccatcctcgccgtatcgccgggtgatctcgtacccgagcattgtgcccaccgtacggttgacgttgcgaatgtcggcggtgatacgcactggcgtgccgttctcgagggcgtcgtgcgcctgttcgatgagcacgttgtcgagggccgtgtcaagctcatggttctgttcgatcgtctggtggagcaccgtgccgggaaccggaccgctctgcatgagcacatggctcaagtcgatgcccgcggacttccagcgctctatggcgtcgttctggtccaggcactccacatgccccaccgcttcctcgagcgtgcggaaaccgagctgtgcgagcagttcacgcacttcctcggcaatgaacatcatgaagttcaccacatgttcgggtttgccggtgaagcgtgccctgagctccggatcctgcgtggcgataccctgtggacaggtgttcttctggcatgcgcgcatcatcacgcagccctccaccataagagcggtggtggcgaagccgaactcctccgctcccagcagcgccgcgatcaccacgtcacggccggtcttcagttcgccgtcgcactggacgacgatgcgcgagcgaagaccattgagaatcaacgtctgctgggtttccgacagaccgatctcccatggcgtgccggcatggcggatggcattgagcggggccgcaccagtaccgccgtcatagccggaaatgagcaccacgtcggcatggcacttggccacaccggccgcaatggtgcccacaccgaattcggacacaagcttgacatgcacgcgagccttcggattggccatcttcgcatcgttgatgagctgcttgagatcctcgatggagtagatgtcatgatgcggaggcggcgagatgagctccacaccaggtgttgcatggcgcaccttggcgatccacggcggcactttggcccccggcagatggccgccctcgccgggtttggctccctgcgccagtttgatttgcagatcggtggcatgcaccaggtaatcgctcgtcacaccgaaacgggcggaggcgatctgcttgatcttgctgcacagtttcggatcgttgagccgttccgttgattcgccaccctcgccggaattggagcgtgcgccaatcgaattcattgcgatggcgagcgtctcgtgggcttccttcgagatggagccatagctcatggcacccgtggagaatcgcttgacgatctcggtggccggctcgacctcactgatgtcgatcggtttgcgcaccgcgttgaacttcatgagtccacgcagtgtcatcagacggttcgatgtgtcgttgatatgcgcggaatagcgtttgaacatgtcgtagtcgccgcgttgggtggactgctggagcaggaagatcgcctcggggtcgttgagatgctcctcaccggtgcggcgccacttgtattcgccgccggtgcgcagcacacggtgcggtgtcgccgtccattggttcggatatgcctcgcggtggcggatcgccacctcctcggccaggtcgtcgagcccgcagccctcgacacgggataccgtgccggtgaagtacttgtcgatcacggcgctgtcgaggccgacggcttcgaacagctgggcaccacggtagctcatgatcgtggagacgcccatcttgctcatgatcttgagcacgccggtggaaagcgcattgcgcagattctcgattgcggtctcggggtcgaccgtcacatagccggtgcgggaaagctcctccactgactcaaatgccaggtacggattcactgcggccgcgccgtaggcgatgagcagcgccacatggtgaatctcacgcacatcgccggcctccaccaccatggagatctgggtcctcgtatgcttgcgaagcagatgatgctgtacagccgaagtgagcagcagcgacgggatcggagccatcatatggttggagtcgcggtcggagagcacgaggaaattgctgccgtcggcgatggcctggtcgatttcggcgaagatctcctccagacgggtctccaaggcattgccaccgccggtgacctgatacagtcccctgatcacatacggcttgtaatagcctccgagctgtgaggcgcgatccaagcgcttgagctgggccatctcgtcggaggtgagcaccggctgcgggatgatcaccttcttggcatgcagtgcacagtcttcgagcagattcggttcgggcccgatcgccgaggcgatcgaggtgacgatcttctcgcgttcccagtcaagcggcgggttcgtgacctgtgcgaacttctgcatgaagtagtcgaacagcatgcggctgcggctggagagtacggaaagcggaatgtcgttgcccatcgaaccgagcggctccttgccggtattggccatgggagtcagcaccatcttgagctcttcctgcgtgtagccgaaggcacgctggcgccggtgtacggaacggccggaataattgatgtgctgacgctgcggcagctccttcatctccaccgtgttgtcttccacccattccctatagggatgcgcagttgccagttcatgcttgatcacgtcgtcttcgatgacctcgccacgcgcggtgtcgatgaggaacatcttgccgggctcaagacgtcccttgcgcacaatgtgctcctcacccacctggggcagcacgccgctttccgaggcaagcaccacataaccgtcatcggtgatctgccaacggcccggacggaagccgttgcggtcaagcaacgcccccacaagctcgccgtcggtgaagacgatgtcggctgggccatcccatggttcaatgagcgtgttgttgtattcgtagaatgcacggacgtccggatcgagctccttgttgttctcccacgccgggggcaccatcatcaagatggcatgtggcagggaacgacctgcaaggtgcaatagttcaagcacctcatcgaaggtgcccgaatcggaataccccggcgtgagaataggcagcagttccttcatgtcgccgagcagcttggagctcaggcgcccctcacgagctgagaaccagttgcggttgccctggatcgtgttgatctcaccattatgggcgatgaggcggaagggctgtgccaacggccagctcgggaaggtgttcgtggagaagcgcgaatggactatcgcaatcgtggccttcatgcgctcgtcgaacaagtccgggaagaatggcttcagctgcatcgtcgtgagcatgcccttgtaggtgatggtcatcgacgagagcgatgcgaaatagacgcccacctcgtgttcggcgcgcttgcgcacacggtagaccttgcgatcgagatccacgcccgccaaagccgattgcggatccgccaggaccagcatcttgaacgatggcatactggccagtgcctgcagtcccagaccatcaggattggtgggcaccacacgccacgccagcacctcaagcccctcctcggtggcgatcttggcaatggcctgctcctgctggccgctggtggcgatgtcacggtccaggaacgcgatgccagccgcatagtgcttcggatccggcagcggcgcatcgatgacggcacgcatgaactcatcgggcatgctcatcagaatgccggcaccatcaccggtgttctcctccgctccgacggccccacgatggttgaggttgatcagcacctcgatggcatcgtccacgatcttgcgttccggcctcgtgttgagggtggtgaccataccgacaccgcaggcatcatgctcggcagcgggatcatacatcccctccgggcgatgaatcgtcaaatctagcgggctcgcaaaagtcaccgcaatcacctctccttcatggcaatccatgggcagttgtccaacttaggttagcgggcgtcggcccgttgccgccacttgagtccacataccgaagaacgcactggatgtcaatgggcgaatttcacgctccgggaatctaagctccatgcattctatttcccgcatcattacgggagtatgtcatgccgtcacacggcgaacatacgcccgaatgatgagattcagtgatggaaggcggcatccatgaggcgctcgatcaccagatcgttgagcagtctgccccgcaatgtcgcaatcagcgcgtcgtccgaacgggtgagcaatccctcgttcaccaatgtgtcgattgccgtggaaggaatcttcatgccggtccgttcggcgaaggcggagacattgagaccttcccgcagacgaacaccgagcatgagcagctcctcggcgttctcatcgcagtcgatgagttcgaagtcctgccatggcacacgattgtgctgaagagccaccgcccagactcgcggatgcggtatgtcccatgcgcgcatggacgtccacgtatcacgcgccggataaccctgcccgttggcacctaccggtatgcccgccttgggatcatggccgattcccatatccatgcggcgtaccgcattgtagtggctatgcgcccccggtccgatcccggcccaatccacgttgcgccagtaccccaggttgtgccggctctcgtgcccggggcgcgcccaattggatatctcataccattcaagccccgcagcgctcagcagctggtcggcaagctcatatttggtggcctcgtcatcatcatccggagcctcgatctcaccggcggcgatgcgtctgcccatcttcgtatggggttcgaccgtcaatgcgtaagcggagatatggtgcacgcccagatcaatggccgatcgcacgctgtcgcaccagtcctcgatactctcccccggcgctccgtagatcagatcgacactcgtctccaacccgagcctgtgtgcagcctcgacatccgcagccacattcgacggattgtgggtgcgatccaacgtgcgcagcacatgcggcacactcgactgcatgccgaatgagattcgggtgaacccaccgtccctcagtaggcgcagatacccgggatcgaccgagtcgggattcgcctcggttgtgatctcggcatcctcacgaatgccccatatctcgcgcacggcgtccagcatcgccaccagatcgccggcaggtagcaacgtcggcgtgcccccgccgaagaaaacggtggatgcaggcggctccaccacaccatgtgccaactgccattcatgcacgacccgcatctcgcgaatggccaacgtcgcatagtttgcgcgcgaagcgccctccccgaggtcgagtgccgtgtaggtgttgaaatcacagtagccgcagcggcgaatgcagaacggcacatgcacatacacctcgaatggcatggaggccgaagctggcggatgcgccgtgagcggcgctgctgcatcgcacatggcccgatcagccttcgctcttctgcgcggcgcggatcttgtctttcgtatcgcggtcgttgccgccttcgccggtcgacaacgcggcgacgaaagcctcctgcggcacctcgacatgaccaagcatcttcatgcgcttcttgcccgccttctgcttttcgagcagcttgcgtttacgggtgatatcaccgccatagcatttcgccagaacatccttgcgcagcgcacgtatgttctcacgcgcgatgatgcgggagccgattgcggcctggatgggaatctcgaactgctggcgcggaatgagctcccgcagtttcttcgtcatcatcacgccatagctataggccttgtcgcggtgcacgattgcggagaaagcatcgatcttctccccctggatcagaatatccaccttcaccagatcggccgcctcctcgccatcgtcgtggtagtcgagcgacgcatagcctttcgtccggctcttcaactggtcgaagaaatcgaacacgatctcggcgagcggtatgcggtaatgcatctccacgcggtcggtggagatgtattccatggtgctcatcgtgccacgatgttcctggcacaggtccatcaccgctccaatgaactccttgggggtgatgatgtcggcggccaccatcggttcgacgattcttttgatcttgccgtccgggaactcgctcggattggtcacacgatgcacggtgccgtcttcggcggtcacctcgtacggcacgttcggggccgtagagatgagatcgagaccgaattcgcggctcagccgctcggagacgatctccatgtggagcagaccgaggaagccgcagcggaagccgaatcccaacgccaccgatgtctccggttcgtagatgagggcggcatcgttgagcttgagcttgtcaagggcctcacgaagctcggggaactgggcgttgtcgatcgggaacaaccccgcgtagaccattggctgcgggtcacggtagccgggaagcggctcggtggcgggatgggctgtggatgtgatcgtgtcgcccacctttgactggctcacatccttggcgccggtgatcacgtagcccacctcgccggcacccaacgcgcgcgtcggcatcatatcgggactgatcacaccgatctcaatcgggtcgtaggtggtgcccacacccatcatatgaagtttctcacgtgatctgagctctccgtctaccatgcggatataggtgacgatgccgcggtaggaatcgtagacggaatcgaagatgagcgcacgggcgtccgcatcgggatcaccggtgggtgccggcacgtcgacgacgatgcggtcgagcagctcgcgcacaccttcccccgtctttccggagacgcgcagcacgtcgctcggctcgcagccgatgagactggcgatctcctcggcgtgtttgtcgggttcggcgctgggcagatcgatcttgttgagcacggggatgatggtgaggtcgtggtcgatggccatgtacagattgctcagtgtctgcgcctcgattccctgcgtggcgtccacgagcagcacagccccctcgcatgccgccaaggctcgcgagacctcgtacgtgaaatcgacgtgtccgggggtgtcgatcatgccgagggtgtactcctgaccgtcataggaccatggcacacgcacggcctgcgatttgatcgtgatgcccctctcctgctcgatgtccatgcggtcgaggaaccggtcgcgcatctcgcgttcgggtacgattcccgaaagctggaggatgcggtctgcaacggttgatttgccatgatcaatatgcgcgatgatgcagaaattacggatcaacgactgatcggtgaatcccggctggttatgctgctcgctcacgaaccctcctatacgttggtaactgtatgattctacccatacgccacggcaagcccacggaatccgacaccttccgtttatccccgcatcatggtattcttctcatttgtatgtccttatagaaacacttcgtttggagaatagatagtggcaaacatcaagtcgcagaagaagcgcgttcgcacgaacgagaaggcgcatcagcgcaacgttgcggtcaagtccgctctgaagacctacatccgtcgcacccgcgaagccatcgcttccggcgacaaggccgccgctgaggccgccttcgctatcgctggccgcaagctcgaccaggctgcaggcaagggcgtcatcgccaagaaccaggctgcgaaccgtaaatccagcctcgctctgcagatcaacgccatgtgattcgttcgcatatgcaaaggccccggtccaaccgccggggtcttttcttttgcgtatgcggatatctggaaggagcgagcgttcgtccgatcagcttgacgccggatcaccgcgccggggtcccggagcatccttggaatccggtgcggctttccgacgctgcccgtcggtgtccgtctgcgccctctctcccctcagcagcgtggccggcagatgcacacggtgtcgttgcaccgcgcccggcagtcgaatgttgaatttcaccgagcagatgcgcagcacaatcaccacaagcacaatcaccacatcgaggagcatctccgtattgtccccgatcagccggccagtatgagcgcgccatacccatacggtgaagatgctgccaagcaccgccggcaccacatagagatggggatcgcgcaccaccatcggcacctcattgacgagcatatcgcgaatcaccccgccgcccatcgccgtgaacgtacccagaaacactgcggtcatgcccgaggtgttgtacaggagggccttactcgtgccgttcaccgcgaacaggccaagtgccagcgcatcgatggtgatcatggaccatttgagtttgtcgacctccggatgcaccacggccgtaaccgccccggcggcgaacgcagtaagcaccgaccccatgtcggagattcccaccggtggtaacgccccgagcagcacatcacgtatgattccgcctccaagcgcggtgatccatgcgatgatgatgatcgatgagacgtcatagcgcttgcgtaccgccgtcagtcccccggccatgccgcaagagaagatcgcaaggtactcgaccgcctggaagaacggtgtgctctgcaacgctatttccatgaatcagacttcctgttccgccagtgcgtatactgcacattcaagactacaacggaaaagggcgatgccgtgaagcatcgtccttgcacaccgcatatgcggttgccactggtgtcggctcagcacaccttccacatccagtcgtgcggatcggcgatctcaccgagctggatgcccagcaactgattgcgaatcgccatcgtgagctcgcccggttcgccgtcgccgacggtgacatcgaacttctcggacttgaaacggccgatcggggtgacgatcgccgcggtgccgcaggcgaagacctcggtgaccttgccggacttgatgtcgtcgagcagctggtccaaggcgatcatcgtctcgacgacgtcatggccatcgtcctcaagcagctggataatcgaacgacgggtgacaccagggaggatgttgccggttaggctcggggtctccacatggccatccttgtacacgaccatcatgttcatgccaccgagttcctcaagataggtcttcgtcgcggcatcgacgaagcagacctgttcgcagccctcggagatgccacggtactcgccgagcaacgatgcggcataattgccaccgcacttggcgaaaccggtgccaccgggaccggtgcggaaccacttgtcctccacccagatgctcaccggcttcacaccacccgggaaatacggaccggacggggaagcgatcacgcaatactcgacctcctcgggcgcacgcacaccgaggaacgcctcggaggcgaaaatgaacggacgcaggtagagcgtgtattcacggcggctcggcacccacttcacatcctgttcgacaagcgcggcgcaggaacccaggaaatcatcgatgggcacttcaggcagatacaggcgcttggcggaattctgcagacgttccgcattgcagtcagggcggaacagccaagtggaaccgtcggcatggcgatatgccttgagcccctcgaaacactcctgcgcataatggagcaccgaggcgcccggatccatcttcagcggcgcatacggctcgatgcggcggtcgttccagccttcgcccttggtccaggtcatgtgggccatgctgtcggagaacacctggccgaatgccggcctatcgatgagctcctctcgtttcgcatcggatgccgggttcggattgggcagaacagtccagtcctcggcgagcttgtcgagggcttctggattgtgatgagaatcgttggtcattttctcgcttctttgaatcattcttggaatatgttggcttttgcagcgcttgtggcaccgatttgtctgttactgtaaacacaccccgttacgaatgcgcaaagccggttcatattttgaaatatctcaccgtcagcgaacggacatcttgattccatatgcgtaaaggacccgccgaagacgacgggtcctttacacggattcgcgaacggctcaggcctctgcgcctgcgtccttctcatcttccgccggaacggcatctgccggctcagcggtctcgaaatcggcaggatcctcctgcgggatctcgatggtgaccacggattcctccggatcggcgatatcgagctcgacaccctccggcagctcgagatccctggcgaagatgttgtcgccatcctgcaggccctcgacggagacgacgatgcgctccgggaggttggagacatctgcgcggaccttgagctcctgcgcatcaaccactgcgatggcgccacccttcggggtgccttcgacgaagaccggaacctcgacttcgatcttctcgccggccttgacctcatagaagtcgatgtgctcgatgatgcgcttgaccgggttgcgctgcacatccttgacgacagcgagcttggagtcggcgccgaacttgatggtgaacagtgcgttggtgtggcgcagggccagcgacgtctcacgcatcggcagcttcacatacaccggctggtcgccacctgcgtagatggtcgccgggatctccttggcaacgcgcatgcggcgggcagggcccttgccaaactcggtgcgcagttcgccttcgagaacaatgctattgttagccatgttgcattcctccttgtttccacttgacgcatcaacgagccaaagcggccccaaggagcccactttttgccgagtcgatgacggaggccgaccggcctccctcgccaaagcaactcctcaacactaccggcaggccgcgacatgacggagagcaataccatatatattcgttatgcagtaccatgcaatcagaacgccgcggctccggtatgacaacggaacgacttgcgggtgtggaggcagacatgacgaaacgaatatcgagcgcatggccatatatgggagccgcagccggaacgatgctggcctgtggcatgatcctcgccgccggggagacgatcttttccgtcaccttcgattcgcaatccaaccgttcgttgttccgcaacaagtcacgcagcgctttcgcccagcacgacccggcgcatcgggcagcggaggatacgcaggcgcagctgtggttcgaacagaccagacatgccgagcagatacgcagctatgacgggctaaaactgcatgcatggcgtttcgatgcgaacacggccgcgccactgccccatacccatgccatttgcatgcatggctacaccggaggtcccgaggagatggcaccttgggcataccattacgccaatctcggcatgagggtgctggtgccggcgcaacgtgcccatgaactgagcgagggccgcttcgtcggcatgggctggctggagcgtgaggacctgctgcgctgggtcaactcgattgtggcccgtgaccctgacgcccgcatactgctgcatggcaattcgatgggcgccgccacgatactcgacgtctgtgccgacccgcgtctggctcgcaacgtggtgtgcgccgtcgtcgacagtgggttctctagcgaatacgaccagatgctcgattcggtctccgcaatgcttcacctgcccaaatggatggccaagccgatggtggattgcgccagtctggtgaacaggctcagtctcggcttcggattccgtcaggcgaatgcgatcgaacagctgcatcgcaccacgttgccgatactgttcattcaaggggaccaggacgacatcgtcagcccgcatatgctgggcagactatataccgcatgcgccagccccgtgaaggcgagattgcaggtgcatggcgcaggtcatatactcggcctgaccaccgataggaatctgtattggagcacggtggacgccttcctacgccgctgcctgcacatggcagactgatcgccgattccatccccaatagcgatggatgggggcagggtcccgccacagcgggaccctgcccccatccatctattcaatacttcaatccatggaaatggccgcggactcagccgagcagctccttgacagccgcgatgacggactgcaggctctgcttggcatcgccgaacagcatctgcgtgttgtcttcgtagtacagctcgttctcgatgccggcgtagcccttgccacggccacgcttcatcacgacgacgttctgcgacttgtcgacgtcgaggatgggcatgcccgagaccggcgtaccgggtctgcgtgcggccgggttcgtcacatcgttcgcgccgacgaccaatgagacattggcggccgggaactgcggattgatgtcgtcgagatcgacgagctcgtcgtagggcacgttcgcctctgcgaggagcacgttcatatgaccgggcatacgaccggccactggatggatcgcatattcgacctcaacgccatgctccttgagcagttcgcccagatcggcgagttcacgctgcgcctgcgcctgcgccagaccgaatccaggtacgaagatgaccttgtcggcatagacgagctgcaccgcgagatcgtctgccgacgtttccttcatcgtgccttccggcccctcgccatcaccggcggatgcattggaaccgccgaagccgccggcaagcaccgacatgagcggacggttcatggccttcgacatgagcacggagagcgtcacgccggcagaaccgacgagggcgccagcgatgatgagcgccacattgtcaatggccaagccggacattgcgacggcagtgccggtgcacgcattgagcaccgagatgaccaccggcatgtcggcaccgccgatcggaatgacgaacaccaggccgtagcacaaggcgaacacggtggtgaggatcgcccacaggaggcgctgctgcgggaacacgcacaacagcacgaatgaggcgaccatgagcacgatgaacaggatgttccaaaagctcttgccgggcagcgagaggttcctcacccatttgacgccctgcagcttgccggcggcgataagcgaaccggtgaaggttaccgaaccgatcatgacgcccagaccagcggtgatgagcacgacgatgctcggagtgccctccccggcgaggatgtcattgagcgcgacaagggccgccgcaccgccgcccacggtgttgaacacggagacgagctgcggcatgtcggtcatcttgaccctcttcgccgaggcgacgccggcgacggcacctatgatgatgcctgcgatcagcagccagatggcgattgcattctcgaatccggtgatgaacagtttgacgaaggccatgaccacggcgaccaccatgccggccgccgagatgaagttgcccttacgcgccgtcttcggggaattcatgtaatgaagacccatgacgaacatcacggcggacagcaggtatgcgaaccatgcgataatatcgattggcgtggtgttcattacttgtcgcctcccttccccttggcgtcatctttgttactcttgaacatctcgagcatgcggtcggtgaccacatagccacccacgacgttcattgttcccagcaccgccgcgaggaagatgaacacataggagagccagttgttggcctcggcggccacgatgacgacaccgacgatgacgatgccgtggatggagttcgcacctgacatcaatggcgtgtgcagcgtcgccggcacttttccgatgacctctatgccaatgatcagtgcgaggatgaacagggtgatcgatacgaccagatctggcatcgtcactcccctttcttcttgtcgtcgttgctgtcggcatgcgtgtgggcgaccaccatcgcatcgtcgagctcttcgccctgcctcacttcgagtctgccgttcaccaggaagtgggcgaggacatccgccacgttgcggctgagcagattggaggcggtggtgctcacctcgctggccagatacggggcgccgatgacggtcacaccgccgtcagtcacctgcgttcctatttgcgagccctccacgttgccgcccagctcgctggccgcgcaatcgacaatgacactgccgcggtgcagaccacccacaccggccttggtgagcagcatggggggtttacggccgggaaccttggcggtggtgatgatgatgtcgaattccgcggcctttcggtccacggccgcctgctgctgcgcctgctcctcggcactcaacgcacgggcgtaaccgccctcgccctgtccacgggacaggtcgataccgaggtcgaggaacttggcaccaagcgattccacctcggacttcgaggcgggacgaacatcgtacgccgtcaccacggcaccgagtcttctggcggtgccaatggcctgcaggccggcgattccggcgccgagaatgagcatcttagccggacggatggtgcctgcagccgtggtcatcatcggcaggaaggaaccgtaggcgttggcggccaccagcaccgccttgtagcccatcaccgaattctgcgaggtcatctcgtccatcgactgggctgagctgagctggcgtggcagacgttcgatggcgacggcggttatgccggcgcttgccagcgccgccacatagtcctcgtcggtgaatgagctcagcatgcctatgacccaggtgcccggcttgatgcgaccgatcatctgctcggatggccgatcgacgaagccgagggcatcggccttggcgagtatatcgtcggcagtgcaaacggtggcgccgaccttggcgtaatcctcgtcggtgtaggcggctgcgttcccggcgccctgctcaatcatgcatgtgacccccgccttgcgcaggcgggtcacggtatccggcgtcaacgcgacgcgggattcatggtctgacgtctcattgaaaacgccgaagaccacgttggcttctggtgtttgagccatatgaaccctttctatgcatccccggatgggaatggtgaacatacagcgcccagtctaacgaaacatgcatgtaacaccatggaaaagtccatgtatcgaatacttttgccgaccgctctaccacagcagggccaccgactccccctcattcgtccaaggcgtgactaattacgccagaagtcatcattacgaaagcgtaaggtgacggcggacgattttacggctagacttcgcgtagaaggttttatcaaacgatgaggagtgccatgtccgttttctcgaaggtcaagaagtctgcgtccgatgcgacgcagaagctgctgcaattgggtggtgatttctcgcacccgatcaacgccaatggcgacaccccggactatatcgatccgcagatcactccacagcatcataactacgaggacctgccacatgtcgacttctggggtccggacaggccgaccaccacgttcatcgatgccgactctgatttcatcacggccaacaccgaaggcaacaagccattaccggagaacttcagcatctacaacatctatgaaagccgtgccgaacgtatgcctgacgagggtctgtacacgttcaagcagggcgatgaatgggtcaccaagactgcacgcgagaccttggacgacatccgtcaggtggccaagggcctcatgcatcaggggctcaggaagggcgacggggtggcgttcatgtgccacacctcctatgaatgggatgtcttcgatggcgcggtgctctccatcggcggtgtgatcgccacgatctacgacaccgattccgccgagcagatccgcaacatcgtcgacaattccgacgcgaagctccttgtggtcgaaaccaaggacatgatgaagaagacggatctggcgaaggaggactgcccgacgctcaaggacgtcatgtgcctggagaacggggcgctcgatgagttgaaggcctacggctcgtccatctccgacgagaagctcgacgagcgcattcgcagcgtgaagaagaccgatctgtgttccatcgtgtacacctcgggctccacggctgcgccgaagggcgtcgagatgacgcaggcccattactgctccaccgccacgaacctgccggattatatgcccgatttgctgcataacaagcgcaaccgcgtgctcctgttcctgccgcaggcacattcgttcgcccgtgccatcaactacatctgcgtcgccagtgacatccatatctatatcgcccgtggcatcaagaccctgaccgccgacctcaaagtggcacgtccgcacatcatgatcgtggtgccgcgtgtgctcgagaaggtctacaacgccgcctcgcagaaggccggcaacggcccgaagggccgcgtctttgccgcctcggtggtcgccgctcagaagtacatgcaggaggtgagcgagaagggcaaggcgagccgcttcgtcaccgcacgacgcaacatgttcgacccgatggtctactcttcgattcgcgacgccctcggcggctgcgcaaaatggattgtgaccggcggcgcaccgctcgaccccgatctcatggcgttcttccgcggcgccggcattcccgtgtacgagggatacggacttaccgaaaccaccgccccttgcgccttcaacccgctgactgtgccataccaccaaggttcggttggcatcccgttcccgggcttccaggtgcgcatcggagacggcaacgagattcaggtcaagggcgtcccggtgttcaagcgctatcacaagaacgaggaggaaaccgagctgagcttcaccgacgatggctggtatcgcaccggcgatcttgggcggctcgatgacgacggcttcctgttcatcatcggacgcaagaaggaccttatcatcaccgccggcggcaagaacgtctctccgggccccatggaggaagtgatcaagcgctgcccgttcgtttcccaggcgttggtgctcggtgataagcgtccgttcatctccgcgctcatcaccttggatgaggactcgctgcgcccatggcttgccaagcagggcctcgattcgggcatgaccatggaggacgccgcacagaacgccgccgtgcgcgcggaagtgcagaagtgggtcgatcaggccaacgaaggcgtctcccgggcggaatcggtgcgcaagttcatcattcttcccgaggaattcacgcaggagaacggcctgatgaccgcctccatgaagatcattcgcccgaaggtgctcaagcgctacaacacgctgctcaacacgcagatgtacaccaagcgcaagcccgcttccgaggattctcaacgaggctgataccgctgcatccattgatatgggaaggctcccgtcatatgtcatatgacgggagccttcccatatcaatggattagaagcccaatctgtcgagtttcttggggtcggactgccagttcttcgccaccttgacatggaggtcaagattcgccttgcgtcccacaagacgattgacgggggtgcgcaatcgcttcttgatgcgcacaagatgctcggcgtgcctgccgatgatgatcggcttctgcgaatcgcgttccacgtagatggacaccatcacacgtgctttgccatgcatggcctgcgcatcgtcctcatccatgtcttccggcatgtcgatggaatcgaccacgacggcgagggaatggggcaattcatcgtcgagctcctcgagcagcaccccgcgcaccagctcggcgatggcatcctccgggcgttcctcggtcacctgatccgtcgggtacatctgcggcccctccggcagatgctcgatgagcaccgtgcgcacctcctgcagattgtcgtccccgagcgcactcaccggcacgatgtcggcgaaatccgcgaattcattgatctcgatgagcttgttgacgagttcggtgcggttcagacggtcgatcttcgtcacgatggcgataagcggcaccttccatttgaaggtaccgtcatcgttcttcgtggcgaactgggaacgcagtctgctcaggatgcgccggtcaccgggaccgatctcctgatccgccggcagcaggaatgcgatttcgtcgctgtccgccaatgattcgtccaccacatcgttgagacgttggccaagcagcgtgcggggcctgtgtatgcccggcgtgtcgacgagcacgatctgggcgttgtcggtggtgagcacgccgcgaatcgccttgcgggtcgtctccggccgtgatgacgcaatggcgatctgcatgccgatgagcgcgttgatcagcgtcgatttgccgacattcgggcgtcccacgacggcaacgaagccggaacggtaaggagtgacgccggaaacagcgtcgacccccttggtatgtgtctggtcagccatatcaatcctgttctttcttggtggagttcgagtccggggaatcagcgtcggattccaaggtagtctgatcgacatcggactccggttcgacaacaatggtggaggctttcttgcggcgccccgcggaatccactgcggtgagacgcagaccgcgcgtgacggcactcgaccccacgatcggcacacgtcccagcagtttggtgagcaatccgtacacggtatccacgtcatcttcgtcgagatcgatctcgaagatgtcttccaattcggcaatcggagtgcgcgccggcatgctccacttatgttcgcctatctgacgcggctcgccatgctgggtgtgatcatgctcgtcctgcagctcccccacgatctgctcgagcgcatcctctatggtgaccatgcccgcgataccgccgtactcatcgacgacgacggcaacatggtggcaggtctgctgcatctcatggaacagatcgtcggccggcttcagctcgggcacgagcatgggcttgcgcataatcgattcgatgggccggctcaacgcggcattgttgaagatcgtcgcacgcacggcatccttcatgtatgcgatgccgagcaggtcgtctatgtcattgccaatcaccggaatgcgcgaatagccggaacgcgagcacagtttgaggaagtcctccagcgtgtcgtccttttcaatgcagatcatgtcggtgcgaggcaccatgatctcgcgcgtgagggaatcggatagcgccagcacattgtgcagcatttcggagacctctgggtcgaaccggttcgtctccagcacacgattgatggcggcgcgcccctgctcaagatgaatctcctcgagctcctcgttctccgagagctcggtcttgcgcgcgctcttcgacttgcgcgggtgcaggaacggcgcacaggcataggcaaatgaggccaaatgggagtatgccagcaaaatctccagcggcttgtcggaacccacggaacgcggtctggccaacaccgacacgaacgcgaccaccagagcggcaagcacgccatagatgagttgcagccataccggactggcgaatatggccgcaatgcataccacacaggccccgatgagcacattgctcagaatacgcagaaaagcgcaggccgaagacgtggcatgccggtttgcaacgagatgctgcacgcgatggatcttcgcgatcttcttctgccgggtgaactggctcaattcggaatcggtctgcgcctcgatcatcaggttgttcagattcgccctggtcacccgcacaatggcgctttcaagcgacgccatgagcagtgattgccagaacagtacgatggccacgacaaccagcgccaccaccgtgacgattctcagttcgtccacttcaatgccccctacgttcagtgtccaagctcacggttcgtgccgtatttgcgttcgtacacctcgagttcgttcaccgatccggagggaagcgtcgccgaccaggctgtgccatggtgcaatgcgaagaacgtgagcagcagctggcgctgcagcccgaacatctgccgttcctgctcccgtgtgtgatggtcataccccagcaggtgcagcacaccatgaatggtgagcagcatcatctcctccatcgtgctgtgaccggccgcctgagcctgttgctgcgccacccacgggcagatcacgatgtcgccgagcatcccctctggttcgttccgctcgtcccccgggcgcagttcatccatcgggaagctcatcacgtcggttggcccctgaaggtccatccaacgttcatgcagctctgcgatcggttccgggtccacgaaggtgatggtgagctcggactgcgtgctcacccgcatctggtgcatgacccacaggccgagttccgagaacactttgggatccaactgccattccgtctcattggcgacttcaacgctcatcgtccaccaccatcgcattcctgtcatcatcgtcaccgcgaccaggtgccgccgtgtgcgttattctcgcatctttgccgcctttgcgcctccgtgccgcgtcatcatgcgactcgtatgcggccacaatcctgcccaccaacgcatgacgcaccacgtccgaagcccccagatgcacgaacgcgatgtcgtctatgcccccgagaatcgattcgatcgaggcaagcccggaacgcggcacatcgaggtcgacctgtgtgatatcgccggtgatcaccatcttcgtgttgaacccgagtctggtgaggaacatcttcatctgctgactcgtcgtgttctgcgcctcgtcgagaatcacgaacgcatcattcagcgttcggccacgcatatacgccagcggagccacctcaatggtcccgtcgtcgagataccgcttcatccgttcagcaccgagcatgtcggagagcgcgtcgtacagcggccgcagatatggatccaccttctcgttgagcgtgcccggcaggaagccgaggttctcccccgcctcgacggcgggacgggtgaggatgatgcgcctgacacgcccctcctcgaagtcgcttacggccttggccacggccagatatgtcttgccggtaccagcagggccaatgccgaatgtgattgtattcgactctatggcgttcacataggcgatctgaccggaggtcttcggccgcaccggatacccggcggcataggtgatggtccctggcacactcggcttgcgatgaacggactcaatctgtcgcgcctgcgtgcgctcatgctccttgaacctgcgcagcttctgcacggtcggaccatggccgggcacctcgtcgcgtacatcgttatgcaacacctgctgttccagcatacggcgaaccgtggctgcgtcgagcggactggtgtaagccgcatcgatgagtgcgcgaatgagctcctgcgcctgcgacgcctcgcgctcgccttgccgcgaggtggaggtgatggtgatgcgattgccgcgcacatgcacggtaatctccttgtattcgcgttcgatctcgcgaatcacctcatcgtacactccgagtactttcacggaatccagctgttcgggaatatcgaccgttcgtgttgtagtcgccaactgctcctcttctacatgttctatacgtctgtggtgtcttggagagatatcgtgtcattcttccatgggctcgccggtgagcacatgcgcatgcacgtggaacaccgtctgcccggcgtcctctccggtgttgaagatcaggcggtacgagccgttatatgcgtcatcggcaatgccctgggccacttcgaccatatgcgccaacaatgccgggtcggcctgcgccaatgcgtcgacgttgcggtaatggtcgcgaggcaccaccagcacatgcaccttggcctttggattgatgtctttgaacgcatacacctgcgcatcttcgaacaccttctcactcggcacctcgcagtcaatgatcttgcagaacaggcaatccgcgtctttcataccgtctcactccttggcgtgatggatttttcctctgcccatactaccaatccgcgcgcatattcattccatgaaggaacgcgtcgtccgctcaacagtacctgcctatcgcacggctcagcagcccaagcgccacggggcctgcagccgaggcgcgcaggatgttgcgccccagcacgcagaccaacgcgcccgcctcggcgaagacttcgacctcctgatcgctgatgccgccttcaggacccacaaccacgctgaccgtccgttccttgccgtcatccaggcatttcgcagcaagctcctcaacctggcgttcgacgtccgaccatgtggcgttcgcgtcctgatggagcacgatgaccagattgccatgcaccatgtcacgccgaatcatggcaagaacctgcttgcttgttgccatgccgtgcagttcgggaatgaatgcgcgccgagattgctcggtggccgcacgcagcgtctgcatccatttgcgatcggtgcgccccgctttgaatcttgcgatggaacggtccgcctgccagggtgtcacctcgtccaccccaatctgcgtggccatatcgatcgcctgctcatcgtgcccattcttggccagagcctgaatgaggcccaatctgaccacagggcgttcctccttggtgaatccgagcaccctgacgatgcccgacttgggatcgtccaccacagcctgaatgcgcaaccccgtgccgtcggaaagctgcagctcatcgccttccttcaggcgcatggagccgatggcatgtcgcctcacctcctcgggcaatcgcagggtccaccctgtctgcagttcatcactgctcagcggagcatcgtcactggtcgtatccaccacaaacattgcgtcggtcatagttgtaccctagcgcatatgggtaaccgttttcccttgaattccaaccccttggcgtcggcctcaaaacacgacacgccgaatttgcattgatccgtatattcgcgtatattttctttctgttgcgctgcaacgcacctgtccgggtggcggaatggtagacgcgctagcttgaggtgctagtgcctattttatacaggcgtgcgggttcaagtcccgctccggacaccagctaccggctcctttgggagccggttttttatttccccattcggaaaggcaatcatgcagctggtgcatctcgagtccatcgatgaccctcaggtggaggcatacacgaatctcaccgaacttcagctacgcaatcggcttgaaccaagcaaaggcatattcatagcggaatcacccaaggtgatcacgcgcgcattggccgcaggacgccaaccgatttccttgctggtggaggaaccatggatcgagggcatggccgacatcttcgcgttcatcgatgaacactggggcgacgacattcccgtctacgtcgcctctcccgaacagctcaggcgcatcaccggctaccggctgcaccgcggggcgttggctgccatgcatcgttgggagcttcccactgtggcggaggtatgtgcgaatgccacgcgcatcgccgtgctggagaacatagtggaccacaccaacgtcggagccatcatgcgttcggcagcggcgttggatgtcgatgcggtgctggtcacgccctcatgctcagaccccctgtatcgccgcgccatccgtgtgtcgatgggcactgttttccaagtgccatggacgcgcatagggggcgatgacgtgcactactggccatggcagggtctggaggaactgcatgggctcggcttcaccaccgcggcgatggcgctatccgatgactcaatctcgcttgacgacctcgtgtggcgtctccacgccaacgacaacacgcatatcgacaagctggcactgatcttcggcacggaaggcgacggactgtcacgacatacgatcgcgaatgccgatctcaccgtgaagattcccatgagccatgacgtggactccctcaacgtcgccgcatcgagcgccgtcgcattttatagcacgcgcgatctgaagcatgcccgctgattcggagcgtgggacacatcctccgaaaacggttccatattatgaaacattttgagctttcggcatataggtcaaaatgtgttgatttagacttttagtcggtggtgtctgggtatcgggtggcggtgtggaattcgttccagtcgatgccggtgccgagggtgggttggctcatgggttcgtcgttgttgtcgtggttggtgccggtcttagtgttctggtcgtgttgtttgaggatgtgggcgggatcgggtttggcgctatgcatatagcagtgccattcgcaggcgcggcgcatgtgtgcctcgggcaggccgcggtggttgacgagcatgcgtttgagcgcggcgttgagccctccctcgaggcggtcgctgtcgcgtggcacggggctgtgtgcgctcagtgtggggtcgaagagacagaagagcgtgccgtcgttgaagaggcgttcaagcctgaaataggcgcggcgtaacggtaaatgggtccaccaccatccgctcctgctcgtggcggccttgggatcgtcgggatggtccttggcgtacgtgcgttcggcgagcatgcccttccagcgctcgtgctctcccgggcgcaccactgccgcgcgcccccttgcctcggcagaggcggtcgtcgtcgccttgcaggcgtcgcactgccaacgctgccggccgtttcggtcgtgcccgttcttgcgcatcggcagccagcagatcggatatctgcgggcccgcttcgatcgtgttctcatgacacaatccaacggccccgaaccggcgcgaaacgcggttatttacgggaaaaccgaaaatgacaccccgacacgcctactgccacaacggcaaacccacagcataatcaacacattttgacctatatgccagcttttcttgcaaaaacgacggcgttttgggcgattcggttttacctcacagcgaatctatgcaattattgaggtgtcttcaatgatgaatgctgaacagattaggttctgtggatccgtaggaaggagctgctatggcgaagaagaaccccaagattctttccatcgtcctcgcaggcggcgaaggaacacgtctcatgccgttgaccagggatcgcgcgaagcccgccgtcccatttggtggcgtataccgactcatcgatttcccgttgagcaatctggtgaattccgggtatagccaggtgattgtgctcacccagtacaagtcgcactcacttgaccgccatatctcgcagctgtggcgcttctccacattgctgggcaactatgtctcccccgtccccgcacagcagcggctcggcaagcactggtatctggggtcagcggacgccgtgtaccagacgatcaacatcatcgaagatgtccaacctgacatcgtggtgattgtcggggctgatcacgtctatcgcatggacttcgagcagatggtgaaccagcacatcgaatcgggcgccgagttcactgtggccggcattcgccagccgatcgagcagtccagccagttcggtgtgatcgaggtggatcccgagcacccgaatatgatcaaaagcttccaagagaagccgaaggagacgacggggctgccagacaacccgaatgagatcctcgcctccatgggcaattatgttgcgaacaccgacgcgttgttcaacgcgctctccatcgacagcaaggccgagaacacgaaacacgatatgggtggcgacatcgccccgttcttcgccgaacgcaacgaggccggcgtctacgacttcagcaggaacgagattccaggggccaccaccacggatcatgcctactggcgcgacgtgggcacaatcaggcagttctacgatgcgcatatggatctcatctcctacatccccgaattcaacctttacaatatggaatggccgatttatacgagttcgggcaatcttccgccggccaagttcgtgcatgcggccggcgaccgcatcggacacgccaccgattccatcgtctcccctggcgtcatcgtatcgggtggcgagattcaccattcagtgatctcaccgaatgtacgagtgcattcctggtcgcaggtcaatgattcgatcctgttcgacaatgtggagatcaaccgcagggcccgtgtgaaccgtgccattctcgacaagaatgtggtgctcaccgagaattcgactgttggtcttgacgtcgaacacgacttggcacgtggcttcaccgtgacctccgacggcatcaccgtggtgccgaagggaacggtggtcgacgactagccgcctgtgacgagttgtggtatgtggaaggggccgcctccaatatattggaggcggccccttccacataccacaactcagtatcgtggcatattgtcgaggttgaagcccaatgccgcaagctggtcacggccttccggcgtgatcttgtcgacggtccaacgaggtgtccaagtccagtcgatgcggaactcctctaccaagccggccaaggtgctggcgcattcgtcttcaatcaggtcggtcaatgggcatgcaggcgtcgtcagcgtcatcgtgatgatcgcgcggccgagctcatcgatctcaatgccgtagaccaaacccagatcgatcacatcgatgcccagttccggatcgatcacctgatgcagggcctccttcacatccgccgcagtggcacggccgatctcatcgacacctttaagctcgatgccatccgatcggcatgcgcattcatggtcttgcgactggacgccatggccgccacagcactccgacttgacggcagatgcgtcgtcgttgcccagaatgtccttcgccaacgatggattcgcaatgatcgcctgggcctcatcctcattgccgacgacggcattgaccgcatcgaagatggtggattgcggttcgggaaccagattgtcgctcatatcagtcctccttcatctcgtcatgctcggttgcctcggagtgctgggatgcgagggccttcgccaatgagtccctgagcccctcccagccgagcaatgcgcatttgatgcgcatcgggtatttggaaaccccttggaatacggcggcatcacccaacgcatcctctgcctgttcgtcatcgagaccggcgcctcgcgattccatcagcttatggaactggccgaacagctccatggcctcatcgacggtctttccttccacgagattgaccatgatcgacaggcttgcctgtgaaatcgagcatccttgaccatcccagacgacactttcgatgcggtggggttcactatcgctcacttcgacatgcacagtgacctcatcgccgcaggtcggattgaattggtgcgaccgtgctgcggagcaggactcatgcacagcggtgactgtcgcctcgcctccgattgccgcgggatcgccctccgatgtcagtgtgcccctgccatgtggatgacgcgaggcatcgagaatcacttcctggtacatctgctcgagttcctggcttcccaaatctgccatcccgctcctttccttcattcctacacaagcaacatatatcgttcgggactattccccgccggtcagatagacggaagacacctacgccttcactgcaggaagaaccggcgcacaccttccaccgcctcaaccaacgcctgtgcatcctcgggtgtgttgtatatgcctgaagacgcgcggttcgaagcgaatacaccgaaatgcctgtggatgggctgggcgcaatgatgtcctacacgtatcgcgataccttgggcgtcgatgtactgccccacatcgtgcggatgcaccccatccacttcaaaggccaccgtgccgatgcggttcgttccgtcctgggggcccagaatgcgaactccatcgacttcggcaagccggagcagttcttcggtgatgatgcgttcatggccggcaatcgtctctatgccgatgcccatcatccattccgccgccacacccgctgcgaccacttgggccaccggctgcgtcccggcctcgaaccgtgccggaggcgccatgtactgggcaggcctgtccacgaaggccagctcgaccatggaaccgccgaacttggccggaggcaatgcctccaacaaatcgcgcttgccgtacaggaagcccacgccagtgggaccgtacatcttgtgggcactgaacaccgcgaaatccacgtccaacgcatggaagtcgaccggaatgtgtggaaccgattggcacgcgtccagaatgaagacgcctccgacctcatgggttcgtttgataatcggggcaatatcggttatggcaccggtgacattgcccacatgggtcacggccaccaccttggtccgttccgtgatgacctcgtctgcggtgttggagaggatgcgaccgtcgtcatccagatcgaaccatttgagggtggcgccggtgcgcgaggcaagttcttggaatggcagcagtacggaatggtgttccgcgcgggagacgacgatctcgtcgcccggtttcaaggcgaaacgctcagcgaccttgccaccacgccccaatgaggcgttgccgaacgccgtggccagcgtgttgaggccgtcggtggcgcccatggtcaccacaagctcctcgttgccttcctcagctgaggcgcccacgagtgtggccaccttggcacgggcctgttcgaaggcgacggtggacagaccggccaaggtatgggctccgcgatgcacgccggcgttgaccgtctcgtagaaacgagattcggcgtcaatgacacactgcggcttctgcgctgtggcgccactgtcgagatacaccagcggatggccattgatctgctggtcgagaatggggaattgatcgcgaatcgcagtgatatccgtcatcacaacaccttacgaatagtcatgggtcattcatgccaaagcggattcggaatctgaaccttccggcaggtacatgtcgtaaccggtctcctccagctcgtcggccaactccgggcctcccgtcttcacgaagtgaccctgtgcgaacacatgcacgacgtcgggcttgatgtacttgagaatacgcgtgtaatgggtgaccatgaggatgccgaagtcgttgctctccttggcatgattcactccttcagacacgacgcgcagcgcatcgacgtcaagtccagaatccgtctcgtcgagaatagcgaacttcggcttgagcatctcgagctgcaatacctcggcccgcttcttttcacccccggagaacccttcgttgacggagcgcgaagcgaatttcggatccatcttgaggtccttcatcgcgctggaaagctccttcgcccacgtacggatcgccggcgccttgccggtgacctcggtgacggcggtgcgcaggaagttcgtcatggagacgccgggaacctcgaccgggtactgcatcgccaggaacaggcccgccttggcgcgctcatccggcgtcatcttgagaatgtcctcgccgtccagcagcacctcacccgaatccacctcgtatttcgggtggcctgccagagtgtaggccagcgtcgactttcccgaaccgttcggtcccatgatcgcatgggtctcgccggagttcaccgtgagattgacaccgcgcagaatctgcttgcggccttccttcgtctccaccgatgcgtagagatccctgatttccaacgtcgacattacttctcctccaaaacgttcgtcattgcttcgttctcaccgcgcaccaggcgacggtcgatggcctgcatgagatgcgtggcgatctcatcgatgccgatctcctcgacgagctcaccgaagaaaccgcgcaccacgagctttcgagcctctttctcggggatgccgcgcgattccaggtagaacagttcctcgtcgtcgaaacggccgaccgagctggcatgccccgcgcccactatgttgccgttctcgatctccagattcggttcggagtcggcaacggctcccggcgtgagcaccagattgcggttgagttcgtaggagtcggttcccggtgcggtgggctggatcagtgcattgcctacccatgtggaatgggcgcccttgccgctcagcgcacccttgtagaccacacgggacttgcattcgggttcgttgtgcacgaccatcgtacgatgttcgatatgctcgcccggatcgacgaagtaaatgccgagcatgttgagctcgccatgctcgccgccgaaatcctgatccatgcggatgcgtaccacgtcgccaccgagcgtgacctgcgaatgacgcagcgatgcctccttgcccacatggatgcgatggttgcccacatgcttggagccacgatcccattcctgaatgaaggtcgtgctgatgtgggagtcctcgccggtgacgatctccacgccttcggcgagtctggcattgccatagtgctcgacgacgacatcggcatggacgcgagcgtcggctgcgatgaccagatgcagggcatccagagcgtcatcggttccgaacaccttgaccagcacgggatgctcgagatcctgcttgagttcgatgattgtggattccctggcactgttccattcgacgcaggagacacggtcattcggcatactcacggttccgctcaggtcttcgcccatgttcaccgtgcgcacatcgaccttggacccgtccactgcggagccatcgatcatcgtcacgctcacctgcgttcggccgctgggttcgaacacatcgaagaattcactgaggcggtcgacgggtgtgaatcgccaatcctcctgcttgcgcgtgggcactgggaacgtctccacctcgaatgagcgtggcgccgtgtcggcactcgacggcatggcggcgggaatcgcatacgggtcatttggatccgccaccgggatgttgatttcctttgggtctgccataggtcagcccaccgatccttccatctgcaattcaaccaaacggttgagttcgagcgcgtattccatgggcagctcgcggctgattggctcgacgaatccacgcacgatcatcgccatggcctccttctcctcaatgccgcggctcatcaggtagaagagctggtcctccgagaccttcgacacggtggcctcatgggccatcgaaacgtcgtcctcgcgcacatccacatgggggtaggtgtcggagcgtgagaagtcatcgaccaacagcgcatcacacaccacattggagctcgacccttcggcgccgtcgacgatcttgacaagtcctcgataggcggaacgcccacctcctcgcgatatggacttcgcgacgatggtggaagaggtatggggggccaagtgaatcatcttcgcaccggtgtcctggtactgccccttgcctgcgaaacccagcgacatcgtggaggcgctggcgtagggttcggcaaggatgcaggcggggtatttcatggtggccttcgagccgatgttgccgtcgacccattccattgtggcgccctcgcgcacataggcgcgttgcgtgacgagattgtacacgttgttcgaccagttctgcacggtggtgtaccggacgcgggcgttcttctccacgatgatctcgacgatcgcggcgtgcagcgagtcggtcgagtagatcggcgccgtgcacccctccacataatgcacgtatgaaccttcgtcggctatgatcagcgtgcgttcgaactgtcccatgttcggggtgttgatgcggaagtaggcctgcaacggaatgtccacatgcacgcccttgggcacatacacgaacgagccgcccgaccatgccgccgtgttcagggccccgaatttgttgtcttcaggggggacgaccgttccgaagtatttctgcaccagctccgggtactcacgtacggctgtgtcggtatcgacgaagatgacgccctgcttggaaagatcatcctgaatggagttgtagatgacctcggattcgtactgggccgcaacaccggaaaccaggcggctcttctcggcttcgggtatgcccagcctgtcgtaggtggttcggatatcctcagggagatcctcccagcttgcagcctgcttgccgacgggcttgacatagtacttgaaatcctgcgcgtggaatcccgaaagatccacaccccatttcggcatcggttgctctatgaacgcccggtaaccgcgcagacgcatgtcgagcatccactcaggttcgtgcttgtccgccgagatctcacggaccacgttctcatcgatgccttttttcgccgcttctcctgcggcgtcggaatcatgccatccgtagccgtattcgccgaactgctcgatgatctcgtcgtcctgtcgcagcttgtcttcattgacgcgaccgcgatcggcgatgtactgattcatctccacatcccgtgcggcatggggcgcctggttatctgccacttgcgctgcctcctatcaaattcgttcctgtcctaacctaacagaaggaatgacaaaaatctaggtttttcatcacttttctcccgtaatgttcatcacgtccgcaagactcgacgacgatggcagccgccccatgtggcacgcattcggataacgaaggcccggcgagttctagaactcgccgggccttctagttttgttgccccttattgctggacgtgcacgctggtgccatccacgcaccagttgtagaaccattccgccatgtcccagccgatgccgacgcaaccgtgggaggtgttctcacccagggcctgaatctgcgcatcagtgtatggggtctgcgtggcaatgcgatggatggcgcagccgctcttcgagaaatagttgacgaagccgacgttcttgacgtcccacgtctccttcttgccgtccgaaagcgtcaatgtgcccgacatgttctgagacgggtatttgagccagatctcgaaatcaccttccggcgtgcacatgtcgcccgaggcctggcatttgccggtggcatagtcgttgccttggcctgcggacatatgcatcgtcttcaccgcgttgccgttctccaaagcggtcacggtgtgatccgagagatcgaccacaacgtgccgttttgtctccttcaccttcatcgggtcgagtttgccggaaacggacacggtcccgttccccttgccaaacgcatcgatcgccttggtgccgatgttggcgtctgcaccatcgtcgagtgtcacaccgtcatggccttccttgatcacttcgatctcggtgccgttgttgttgacgatgacctcgcgatcttccttggtggacttgatgttcggcttgatctgctcgtcatatgccttctgcagggcagtcgcatcgtagacgacgttgccgttgcggatctggccttgcggcagcgtgccgttgccgttcgggtcgatcgtcgtcgcggcgaggatcatagacggtgtgaatgcggcgaaccgttccttgccaatgtacacgcccggcttctgtgccatcagtttgtccaacgtggatttggccttgttcgcctcatcggtggtgatcgccggcgagatggtcttgagctgcacctccacggtcttcggttcctgcgctcccagggactgcacgacacgcaccgcctcgttggcggtctcggtcggatcggccccgtgaccctcagtgccttcgatgaccgcgatggtgctgccatcatcgcccacctgcagcttggcgtcgacgggtttgacgctgttggtgcccagctgctcatcgagggcttccggattcgcatccttggcatcgatggccgggttcacgtcatgcttcgcccatggtgcatatcgggcgaatacgttctcatggcgtttcgcatccactgcctcctgggcgatttgctgtgcatcgaccttgacgccgaggtccgccagcgtgaccgacccggttttgccctcgtagctgaccggaatcttggtgccatccacctcgttggaaatggcctgggcaatctgctgctgcgtctttccggacacgtcaactccccagagcgtggtgccaggcagcgcgcgggtattgaagaacgccacaagaccggcacaggcacctgccagcacgacgaccagcgccagcacgatccatggccatacatggtgcctctttcctgcggcaggcccattcatgcctgcattggaatcgtgctgctgtgggagctgtggaggcagtggcacatcctgcatcggcgtgaacacctgcgtcgactcgaaatcacgcatgtcgctggcatccgatggcacctgattgctggctccgttcgaagagaacccaccattgccggatggaaaagtcatattgctccttgaaaacactccccaaagaaatcccaaaaggaattgggcctgtccatattatgcaacatggtcatgaacagcaagcggttcatgaccatgtttcgtgcattcttcacaaagccgcctcaccgacggcacctaagccctattcggcagtggccttcttggtgtcacgcgcctcctgatggtccaacgcagccttcaccaaaccggcaaacaacgggtgcggcttggtcgggcgcgatttgaactccggatgcgcctgggtggcgacatagaacggatgcacatcctgcggcagttccacgaattcggtgagctccccgtcggggctctggccggagatgaccagaccgccctcgcgcagacgatccttgtatgccacgttcacttcgtaacgatgacgatggcgttcagtcacatgggtggtcccatagagcttggcgaccagcgaatcttcgagcagttccgccggataggagcccagacgcatcgtatggcccatgtcgccattgccggcgacgatgtccttctgctcctccatcgtggcaatgacgggattcgcgcactccgggtcgaactccgaggaattcgcatccttgatgtcgagcacgtcacgggcatattcgatcaccatcgactgcagccccaggcacagtccaagtgccggaagcttgtgctcgcgtgcgaagcgcagggcgccgatcttgccgtcgatgccacgaatgccgaagccgcccggaatcacgatgccgtcgacattgttgagggccgcagccgcaccggcctccgtctcgcacagatcagcggcgacccatttcacgttgaccttggcccagttggcgaaaccgcctgccttgatggcctcggtgaccgaaagataggcatcgggaaggtcgatgtacttgccgacgatggcgatgttcacctcatgcttggggtggtgcacgcgttcaagaaggtcctcccactcgtcccaatcaacgtcgtggaacggcaggccgagctctcggaccacataggcgtcgagaccttcgtcgaacagcaccttaggcacatcgtagatgctgttggcgtccacacagttcaccacgccctcggagtcgacgtcgcacatgagcgagatcttgtctttgatggactggttgagcggacggtcgctgcgcagtacgagtgcatccggcgagatgccgagctgtcgcagcatcatcacggaatgctgcgtcggcttcgtcttgagctcatgggcggcggcgatgtagggcacaagcgatacatggatgaacatgcagttcccgggaccgagatcacgacgcacctcacgtgcggcctccatgaacggctgcgattcgatgtcacccactgtgccgccgatctcggtgatgatcacgtcgacgtcatcggaggcctgcgcacgcatacgggatttgatctcgttcgtgatatgcgggatcacctgcacgcactggccgaggtactcaccagcgcgttccttgcgaaggacctcctgatagatctggccggtggtgacgttcgccttctgtgaaaggaagacgtccaggaaacgctcgtagtggccgatgtcgagatcggtttccgcgccatcctcggtcacatagacctcgccatgctggaacgggttcatggtgccgggatcgacattgatgtacgggtcgagtttctgctgcagcacacgcagtccccggctgcgcagcagacgtccgagagaggaagcggtaagacccttgccaagggaggaaacaacgccgccagtgacgaaaatatgcttggtgacgtgttcttgagcattgccatgttgtcttctaaccatgggtcttcatggtatcgctccggcatgacatgcacaaagggactttgctcgacactgcgttgcatcatcctcgctccatcaacaagagggcgcaccttgtgaacacgccctcttgtatttcgcctattcaggcacttgtctcttgccggttcaatgttcgctcatggggagagtgaatcctgagtaacatgccggagccggcgatgagcagcacaatgaccatcgcaatgatgactgcaatcgacgagccagtggacgccgtaccgccatgtgaggctgacgcgttgttcgcaccattggccgcattgttggcgccattatgtgcgttgtcgccacttggcttgtcaggctgatccgaattatctgggttatccggattattcgggttatccggattgtccggctcactcatcaccgcggttgggccgagcagcagggcgctcctggcaggaaccgcgatggcatcgccgcccgcgatttgcacagtgctgcctgccttcgagacatccttgccggtatccgctggtgcggcaacagctgcagctgccgtcgtatcggagactgctggatgcagataggtcttgccattggagaccagcacgccgtatttgcctgcggtgacaccattgagatcagttggctgatcattgtggttgagcacaaccacgtagttcacgccgttgtcatccttgacctcgtatgcgacgaggccctcggcggactacaccaccttcgcgttcttgttgatcgtgccataggcgccgacacggagcacagcgttgcgcttacgaatcttgatcagaccgcgcatgtactgcgcgttgtccgcgtactcggcgtcgttggggcgatcccagtcgagcttgttggtgtcatcgccagcattgtagctgttctcgtcgccgcccttcgtgcgcagcatctcctggcccacctggaattcggagacgccatgagcaaggaagaccgctgaatcatcaagcttcgaaaccgtgatcttctcggtcttctgcgctgcgtcaagctcatcgtcggtcttcttgccgaatagcgagacattgagcttgtcgttgagcgtcagattgtcatggatctcaacatagttgacgatctgccctgcattgccgtatttcacgttcgcgttgccgttcgtgcagaatgagcctttcgagatgccttccggattctggcagccgagcatgttgttcaggatcagaccctcggtgttcggcttgctgcttgcgaaaccggtgtcttccgttgagaacacgaaacccttcagaccgtcgcgaatcgaatcgttgaagaacgcgaccgtggagttgtggatgtcgagctcgtaagcattcggctggatctgcacatgcgtgacgccgagttccttcaggtagtcgacgccagtcgctttgcctttggagttcttcgtcccgtgcttaatcatgccgaaatacttgccgcggtgcgcttcgaaaatgccggcgtcggtgtttttcgtgaatggggccattcgcctgaaatccttgacggtcgtcactgcgttggacagaatgacggaacggcgtccattgactacggatgcgcgtgcatacgggtctgcggaatcgttcgtcgtgccgtccgcgaaagacacacggtagatgtaggcggcgctggaaggaaccttttcggtagcgttccacacgcccttctcaccaagtctcatttccacgacagcggcctcttcagcgtccgcggaatcagcggacctgaaagtgacgagctcaaccttctgtgccgtcggagcccacagtttgaaggcggtgccattctcttcgtatgtcgcgccaaggtcgtttatagtcggagagcagacgcggcgtgccgtagtcgtaggcgagcatgaacgcgttcgcgagcgcgtacatcgaaccgttcttgtacgtgatcgcgccgtcgttgcgggcggtgtcccagttcggcacgaagacgttcgcatccttggattcaaccgcgttcgggttttgcgataggtcgccgatgcgcatggaaaggtctttgagtccggcgatcttgcctttgaatttggcgttgaggtccgacttgtagtcgaactgtgtgacggtgcctgttccaagatagttgcgcggctggatgccgggcgcctcgttcgcgttgccgatgacctcctgaatccagtagatgtcgtcggcactcttgccgatcttcctggccatctagtccttgatggccttcatatcctcgttgttgacgtgcttgacctcatccatgcggaagccctgtacgcccatgttgtagagtttggtcaggtaatccgactggatctgccgcaccttctcgctcgacgtgtcgaagtcccacatcgagctcaaacggccttcctgcacctcctgctggttcttgtagtcggagatgttcgcaccgttgtcgtagtcgtggaagtcggcggcggtcacgccgtcggggtaccggttgctctcgccggtgaatcctgggtagtcgccggtcgtaccgttgtatctggtgcccacgacgcctgtttgctcacctgcggcgacgtccgacccggtcgtctggttgagcacgacgtcggcgatgatgccgacgcctgccgcattgcactgttccaccatggccttgaactcggcttcggtgccgagtttcgaatcgagccgatagctgaccggctggtaggaggtccgccactgggtgcctcggatcgattcctggggaggagacacctccacataccgaatcccctagggcccataggtgcgcccgcattcttccgcgatggtatttcatgtttgctggaatgcgatcatctgtatgcccgtggccttcggcagccgggactgccggtgtcggctggcgccgcattcgccgcattcggtgccgcgatcaccacatcggcgcacagcgtggccaatgccacgccgatgcctgcggtccggcgaaacgcggtgtgcatgtgctgaataaccatgtcgttcctgtccttctaatccagtggcgacgcaatgcaactgcgcatatgcaatcgcctctttcctgacgtatgcatcttgcgcgcggccatgcgcggattccacaggtcttcgacaatgagcgcatgcatacgtttgcatggaatctccatcagtgtatgacgttttccgattgcgtgcatcctccgacgcattttcgtcgctttgccctgcgtgtttgaagtccccccgccgcgcattgcacgcatgacacatggtttgccgtaccggagtccgcaaccgattgcattcggatgtcgcgtcattgcaggcatccggaaaccatatgatcgatgccatcaggcatcatgcgcacgtttgcacgaaaaatccccgccgcggatgcgacggggatgctggttgccaaccgaattaattatctggttagctcttcaccaaccatgttcattgacaaacgcttcaaacagtttattttgccgctcaagatcaagctcctgcgcatgcgaggattccgtgtcaccgcgcaatgtcgcgacttggccaaccacagactgatattcccgtgcggcatcatcagcttgtcggcccagctgctccaaggcagcgcgctcgttctgctcgagccgcctgttgagggcgtagttcttggtacatggctccacttcctgttccgttgccgcctgtccggtgaacagcgctcgcacggtatcggcatcattctgggattgtcccgccctatcgggatcatcgccgacccgtgaacgtgcaagtacagccgcttttgacaattcaatcacagcacggtttactacagcaccgcgcaagagcaacagcacggcactgatgagcgcgaaaccgcagacgaccacgccgacgcatgcgattgcatacatccacatggcatagactcgtccgacgatgacagccaccgtcagcagagatagacccgcaatcgtcaacgtcgcgaaatcgattgtctggcggcgtcgttcttcaaggtatgcaagctccggagcacgtcgacgctgcatattggctactgcattggcttttcgctgcctgtccattaactgctcggcccgtgctcgcgtcagctgtaattcatgtaccctcacgtccattgttcgttccctcgtttctagttgtgcccgagcttttccaatatggtgtccggctccaatccacgcctctgaatggcaagccgcaactcgtcattgcgttgacgcaccgactgtgtgcgggcttcctgcgcgtcgaactcattccaggcgtccgacagatccgtctgcctgatggtctcggcatcttgttcatatcgggctcgcagatcggactgttctccttgccgcgtgtgcaactgttccatcttgtactgatgcagcagcgcatcccattgcgtcgtagcttgcgcgaaatcgggagtcgcaggactcgtaagcagctcgatgatggcgccaatctgagtcccatcgcggtattcctgcggaatcattctcaaaatcggctcgatcttcagctcctgggcatacgtgaaattctcctgcacgccttgcgccgccaacgctgccagcaatgttgagcggcttttcctcgccaacctgccttcccgtatggccgaggtgatcagaacgccgaaaacaatggccatgagcagtgtgatgatcccacgaaggcgcccagccgtctccacgtcggctcgacatgccgctatcgcaaaatacgcacctgggatgatcgccacacaccacaccgcccatacaagtcgcttgcgcaatacagcacaggcgttttcaaaggcctgccgtgcggttgcgacttcatcggccgctttttcacgcgccccgtcagtgaattcaagcgtcttctgtgctctggcaagcagatcaaggcgacgccgcggcggataatcatccaaacgccacgcatccgcagacagcacctgatcaagaggctcgtttgatatgaagtcggaaatcagcttggatgacgcatcatcagactccgtaccgtcaccgcagtcaacaccgatgtcccggaacgcctgaaccatgtccacgccatagaatgtcgacggcaggaggcatccgttgacgccgacgatcgatatatgctcagggtcgtcattgagccagatgaaacccaccgccggttcgaccttgtcttcgaccatcgtcagcccagcaacatattggagcctgaaggcgggtacgccggggccgcctatcccctgtgtgatcttcggatcctcggatcgatccgtcacgatcgcaatcgcgttgagatccgagtaatcaacgatgacgacatcgtgttccctcattgtgcgccgtgccatgatcatcctttccttaacgtaagcgttccagtagcgtccactagtatgacctccaatagaacaccgtgtcgtcagataccgaatcagcggcccgtcccccataaggctcaacaacaaggtacactgctcgcgtaggcgggttcgagtcatccaagccttcgataggtgaatcacttgttgaaatcactcgtgttactgaaagtggtctctgtacgaatttaatacctgaccgaggtacgtctggcaatgacatgtctaccgtgtgcaccgcctcaccgtcgcacgccacattgttgtaatactgcgcccaaacctcgcaatcgatgcgataagtatactgtgtgatcaattgctgcgcgccagaggaagtattgggattatcttgatggacataccccaatgggattgtcgtctggccgttcggcagtgggttgaggtcccccatccgcgacgtatccaacacgagaggagaggtattgccttcggtctgcggcgtgatcttgacgcaggtcacgccatcgcttctgcaccatgtgcccctgatgttgtcgggatcgaatcccgaattccccgcagtggcgccactatcgtccgcactgtccgcggtattcgtatccgactgtgcggacccttcattcgaatcttcctgtgtccagccggaactttcatcgtaatagtacggattatcagcaccagagcccgggatcccagcatccccaccatcgattgacgactctgcggaaacggactgctgcatcggaagccgcgtctgttctcggttgcgcacgaacaccaacgacaacacgatgctgagcacgcagacgacagacaccgcggccagacgtaccatcggcatccgcatcgacgcgtcgtgcggcgcaggcaagccgatgaactcgttgtcgcccttacagagccttgcgacattcctgcccatgaaacgctttggcatggtataaccctgcactccgtcgatgcgaatgcgcttcggatcatcattcaaccatgactcaccgcgcgcacccatcgtggtgccgtgctgcagattcttgccaagcacccatcggatcagatatgctgttcttccagccgctcccacaccacccgtcttttctgggtcatcggaggatgcgacgacgaatcctatccctttgcacccattatcattgacggccacggcatcgccgacttccatgtccctgcgccccatcgccactcctatctttatatcttttataaaagatatggtttcaaaccagcctaatttgtccacagcgccctgtcaaaccgacatgcaaagctcgcaacggtcacgacatgcccgaatgttgctccatcttggtacaaagataacgaagtactttgcacggaagggcgatgatggccgaaatcgtcaccatgaaaatcggaccgcggaaaatcctggactacgacgagaaagatcctgacaacaacacaatcgccgccatcggctggcacgacgggctcagccagaaagaggtctggagctgcagcgccggatggtggaagctggaaccaggccgtgccgtgcgatgcgacatcggcattgtcctcaatccggacaacgtcgtcgtctgcgtcgccaagatcaaaggcatcgtcaagcgcgaggacatgcgtatgtggttcctcggagacctcgccggagagcgttatgaaccttggattggcaagacattcgagcgcaatgactcaaagaacccgatcgcctacttcgacgagcacgcaatcatcccgcctgaatctgtcaccaacaagatgacaatcctcaacagccggtagacaggccgaaacacgcaaaggagcgtgtctgccatcattttatcttttatataagttatcatgatgcaaagttactgtccgcgcatcgaagaaggcacctatgaccacgcttgggttccgttatcgcattcgccagaacaccggtgttccacgcccactacgtgcaaaataacttgaacaggcagtcacaggttggctgtccacgctcgcgtggtcggattggacggtcacttcgccatcggacgacagagccgaaaccgtaccgattccgttcacatccatcgcacgcctgcaatgcgtgggcatgccagacggcgaattccgcgaactgaacatcatggcgttcgacgacaaaccgttctatcgagagctcatcgacgacgaacatggcacaaacatctatgacgaggccatagaccgactatggcagacggtgcagctgctcgaaatcaccataaccgccgcgaacacacatattgccttcatcgaccttgacagcgaactcattgcctttgatgaagaggacccgaaaacactcccctcactgtgccttggccagattccgcgattgacgggttccctgtccgttttccgacgacacccgcaggccgcggaaccggctgatcttgtgttattcgaaacagcgagcttcaccattggcgaggaatggttcgacatgatgatccatggggcgaatgcgctggatgtggcctatcgacatgcgcgtcgccgattgcgaacgtctcgtgatgtgtagcggaaacagcaaaccatacgatacagaaaaggaacatatcatggaaaacaacaatccaccaattaggttctttgaaatgctcggcctcagcgaagaggagctttcggagtatgcaatcagattgaaccaaagtagcggcgcgtggttcgatgcaatgacgatgtattacgagcatcacgacgagctcatggattgggtgttcacacgccgctggaacggcagcaaggccggaggaaacatacggcagcccaaggtgctgcaattcatccagctcgatggacgggagaaacccgcgatccattggttgttcatcggaggctatgaggtcggcgaaacggtgatgcaggggaatgacgaagtctaccagcgcaagccaatcgaacgtttcctcccattcgaggcgcgcaccgtcgtcgtgtaccgtaagaggcgcggcgcgacgcagatggtgaacggcatggccgatgccggattgcgttctcgcttcttcgatacgatgctcgtcgagaagattgcgcagtcgccggtctcggcaatgccattccctggctacgacaacgtgcggctatcgttctccgagcttgtagccgctgtgcataacgacgaatggcgtggcgcgctaggagccgtcaacgccgtgtatctgcagaccgacacgcgtaccggttggcactacgtcggatcagcatacagccgccatggcggagcacaaggtctgctctcccgatgggaggaatacgcgaacggagaccacactggcggcaatgcgctgctcaaggaccttgtcgcaaaacacggcgtggaatacatcgagcagtatttccagtactccatcctcgacatctttgacccacgcgtgcccgaccgcacagtcatcgaacgtgagcactggtggatggatgccctcagctctgtacgtgacgacagagcgtcatcaccgcatgggtacaattccaaactccaatggaatcgtaccagcgaaggaagggaagccggactgagctgattgatctgaggatctggtgatgaatggcacggggacggcagagtgtactctgccgtccccgtgccattcatcaccttgaggtgtcacacggatagcggaagcttcccgcgccgcgttcatctcagctcttggtcagttctgcgacggcctcgagtgcgagcttgtatcccaggtaacccagtcccgtgatcgtgccggtggccaccgggctgatcaccgaacgcttgcggaactcatcgcgtgcggctggattcgagatgtgcacctccatgagcggcaggtccgcgtcgagcaccatgtgcgcggcgtcggccaacgcataggagtaatgggtgaaggcggcggggttcatcaccacggcgatgcgccggtccgcggcctcgtgcatccaatgcaccatctgcgcttcgtcatcggtttggcgcacatcgacgtcaaggccgtattcgaccccccaccgggtgcagagtcgacgcagctcctcgagatcctgcgaaccgtacacatccggctgacgcactccgagccgccccagattcggcccattgaccaccatgaccttgatcggctgtgacttcgttgccattgtccctccaattcgttgccgttggctgctctccactatagcgaggccggagcgtgtatgggtggtcggctcccactttgcattctgggcgtatattcacctcgcacctgccggaccgattccattcacgggttctgcacacggtggaaggcctcctctacggcctccgaatcggggtcgttcagatggaacggctcccccacctgttcaaggcccacgaaccgcagcgtgttgccacgggctttcttgtcacgatgcatcaatgcgaggacctcatcgaagccggcgccgttccacgatgtcggcagaccgaggctggtgagcagagaccttgtgtagtccaccgtgtcacggtcaaggtgcccggtcaggctcgacagctcggcggcatagaccatgccaacggccacggcgttgccgtgacgccagcggaaatgctcgagctgttcgattgcatgaccgaaggtgtggccgtagttgaggaattcacgcaatccggcctcccggagatctgcgctcacatgatgggccttcacacggacggtgcgctcgatgagctcactgaccacatcctccagaggcgtgcccaggaatgtctcgccactgaacgcgcgcagttcggcggcatggtcctcgaggatgcgcaggatctgcggatccatgatgaacccggatttcgccacctcgcccagcccttcgatgaagatgtcgttgggcagcgtggtcaacgtgcggaggtccgccagcacgccggccggcgtgtagaacgaaccgaccaggttcttgccttgaggggtgttgatgccggtcttgccaccggtggaggcgtccaccatggcgagcagcgacgtagggcagttcacgtagcggatgccgcgcatccacgtggctgccacgaatcctgccaaatccgtgcaggccccaccgccgatgcccacaatggcatccgaacgggtgaagccctccgtgcccagccgttgccagatcccattggccacctcgatggtcttgccggcctcggcgtcaggaatcacaatgtccgatacctcataacctgcctgacgcagcagtccgcgagcacggtcgctatggcgctgcacggactgcgtgtgaatgagcgccacgcgcacgggctgcttgcccagcacttcaggcaggtggctcaacgctccttccccaatgcgcacatcgtagggttcgattcccctgccatcaacatgtacagtgtgctctgcaaccatttctatcatccttttcgccgcggctttgggcgtcataccccgcgttggcacgaccagattcgccacctgacggtatacggggtcgcgttgtctgaacagcgacatccagcgtttctcggcatcgcctgtgagcatggggcgaccgcctccccggttggcacgttccatggcttcatgtgggtcggccttcaaatacaccaccttgccgccccgggccacatactgtgccaggcgccgacgtatggccttcgtcatcggcgctccgcctcccagggaaaagatgccgccgaaggaatccaggatatcgcacaccacatcacgctccacctcgcgaaatgccggttccccatattgtgcgaaatagtccggtatgctcatgccgatctcgcgttcgatctccacgtcggcgtcgagaaatggcagaccgcgcatctgcgccatctccttgccgagtcgagtctttcccgcacccatcatgccgatgatcacggcctgcggttgcctgcggggtttgcccgcgtgcctgtggttatgtgccatgccctgcaaccgcctaacgcatgtgctccggccacgaggccagatagccttcgatgttgcggcgcgtctcttcgatgctgtcgcctccgaatttctccagcaggtgctgggccagtgtcagacgcaccatggcctccgccaccacggcggcagccgggactgcggtgctgtcagagcgctgattgatggcctgggcggcctctccggtggtgatgtccacggtgcgcagggcgcgcggtatggagggaatcggtttcatggccgcgcgcacccgaatcggctgcccgttggacataccgccctcgatgccgccggcacgattcgacaagcgtgcaatgcagccatcatcgcctggcaccatctcatcatgtgccatggaaccggggcggccagcctccaggaatccatcgccgatctccacacccttgattgcctggatgcccatgaccgcggcggccagggcggcgtccagccgacgatccgattccacgtacgtgccgatgcctgccggcacaccgtatgcgatgacttcaatcacaccacccaacgtgtcggccttcgccttggcctcatcgatgcgggccaccatgcgctcctcagcgtccttgtccagtgtgcgcaccggagaggcatcgagggccgccacgtcatcagggcccggcagcggcgtgttgtcactctccacaccggcaccgccaatcgagatcacatggctcacggttcgaatgcccgccacctgctccaggaacagcgcggccacttcgccgagcgccacgcgcgatgccgtctcgcgggcgctggaccgttcgagcaccggacgagcatcgtcgaaaccgtatttgcgcatgccggtcagatcggcatgccccggtcgcggacggctcaacggcgcattgcgtccctcgcgcgcaagttcatggtcaagtgggtctgcgctcatcacctcggtccatttcggccattcggtgttgcctatctcgatggcgatcggagaccccaacgtgctgccgaatcgcacaccggtcagcaggcgcacctgatcctgctcgaacttcatccgagccccacggccataccccagacggcgtcgcgccaatgcatcgcgaatgtcctgcgatgtcacgcgcacacctgagggcatcccctcgatcatcgccaccaacgcctcgccatgggactcgcctgcggtctgccaacgcaacatgcctactccttttgttctacgtcaatcccgactatcttaaccatatgtattggctaatcactataccgagcttggtctgtggactcgcgatctcggtcaccgacctgaggcgccgcattgtgccgcgcccatgggtcatggcaggtgtggccgtgcaatgcgtggtcttcttgacagcggggattcgctcgcacgacctgtggcccttcgtctgcgcctgcttcgggctggtgggtgcagtcggggtgcagctttcgctcgccatggcgatcccccgccatgcgcttggtcttggtgatgtcactgccagtggcatggcgggatttgccacggggtatttcggactcgaatgctatctgtggttctggctgtgcatgggcgtgctcggtgtaggttgggtgcccgcctattccgtgtattcccgggtacgttcgcgtggacgcaccggtgatggggtgggacgtctgcgggtgccgttcgtcccggtgatagcaacggcggctgcacttgccgtcatgtgttgtgcatgacggggcgcagccgccgtggacagctgaaattcaggttccgcatccgctcgtcagttcgcgtcggggttgttcctccggtactcctgcacaagctgttggaactgttcgtcggtgtcggcgaattttgtctcgccggtcttcagatcggtggtcacgaagtacagccaattgccgtcggcaggatgcatggccgcttcgatggcgtcatcacccggattgctgatcggtgtcggcggcagaccgcgattcacacgggtgttgtagggattcgaggtgtcttgcaactggtcgttggtcagttgcatgccgttgatgctggcaccataggccacggtgctgtccatgccgagcgtcatgtctttgtcgagacgattgtagatcactcggctcaccttgctgtagtagtccgatgagttcacctccgcctccacaatggaagcgatgatgagcatgcgctcgcgttccgcgccttggggaacgcccatctcgtcgagtttgcgaatgcgcgcgtccaccatctctttgagcagccgctcgggagcggtcgcgacatcacccacagtataggtgccaggctccagccagccttcgaagttgccgttcgcctctgcgggaaggatcttcgacgcctcgtccctgttgttgacaatcgcttcgaaccgtgtcttgtcgatgtcgttatctgcgcagatccgttcgatcacggtggacactcgttcgccctgccgcacctccgcgaagcctttcgcgttgccttggtcggagagtatgtccgccgcctgtgacgccttcatatgcgtcttcaatgcataggtccccgggtacaatgtcttgtcgttcgaggaaacataggtggcgaaggtgtctgccgacttgacgatctgctgttgcaccagattggcacccacctccatgatgccctcgccctgcttgacggtgaaggcgacatcggtgtctcccggtcccggataatcctcgacgagggattcatgggccatgttcgtacgacgccagttccgtgcggcccggtatgcgaacaccccgccgaccgagatgagggcgagggcgatgacgacgatgatgcagatgatgagattcctgcgtttcctcatcgcgcgttggcgtcgcatctcgcgcctgctatggggaggggcgggtggcatggccgccggttcggcgccatcgtcccaggattcgtcggcattgaagaaatcatgcaggtcgtcggacacttcaaaactcctctgtgttatcgcgtgcacgatcaagagccgtctggaggatctcaaccgccgactgctggtcgacgacggctcggtgttgcttgctgctgacattcgcgtcgaacagacgacggtgtgcgtcgacggttgtcaatcgttcatcgatgaatatgatatccggcatcacgccgatgtgagagtcctggtcttccatttcggactcgagtcttctgcgcaacgatttcgcccaccgctgcgcctttttggcgctgcttcccgcggaaccgtccatctgcagcggcaatcctatggcgatggccgtcacgggtgtgccttcttcggccttgtcttctataaggtccagtacatcgtcgaaaacctggaaatagtcgccgtatacgcgaatgttgccctcggggtatgcgaaggaacgctcggggttggaggcagcaacccccacccgagcgttcccgagatcaagtcccagccagattcccggcatcaggcgcgcatcgcctcttgcgtcagggcttccagcgcggcatcgatcttcgaggcatcggcaccgccgccttgggcgaaatcgggcttgccgccgccaccgccgccaagcatcttggaagcgccgcgaaccaggtcgccggccttcacccccgccttgcgggctgcttcattggtggccacggcaatcacaggcttgtcgtcctcattcacgccggcgagggcgacaatcaccggtttgtcgtcacccaaccgtccgcgaatgtccatgacggtcttgcgcagcacatcgaacgatccgaagtggccgacgttcttcgagaccaccaccaccggggcggtcgaattggcggcggcctcaacgagttccggcaccgacgacgccagctgagcctcgtacatcgaggcaaggcggcgatcggagtctttgagcttggctagcaatgtgttgatgcgatcggccagctcatcgggacgtgcgttcaacgtgtcggagagctgggaaaccagtgcatgctcgcgggcgttgaaatcataggcgctctgccccaccagtgcatcgacgcgtcgcacaccggagcctacggatgcctcggagagaatgttcacctgaccgatcttgcctgcaaagtccacatgcgtgccgccacacagctcacggctccagccatcgtcgccaatggtgaccacacgcaccacatcgccgtacttctcaccgaacagatgcatggcgccgagcgcaatggcgtcgtcgaatttcatctcctcggtgctcacatgcaggttgtcgcgcaagcggtcgttcacgcgggcctcgacagcgctcatgagctccttggtgggtgccgtcgaccattggaagtcgaatcgcaagcggttgggggcatcctccgagccacgctgggtggcctgaggtccaagctcctcgcgcagggccttgtgcacgatatgtgtggcggtatgcgaacgggcgatggcaccacgacgttcgacgtcgatggttgccgtggcttcggctcccaccacgagcgtgccttcgatcaaacggcactgctgcacaatgaggtccttgattggcttctgcacatcgtccacctcaagcacggcgccatcatcggagatgatctcaccctgatcggcaagctgtccgccggcctcggcatagaacggcgtgcggtcgagaatgacctccacggttgccggcgcactcacagccggcaccgaaccgacaccctcaagcatgatgccaagcacgcggctgcgggtggagacctccgtgtatccgaggaactcgattggctgatgcagcttgttcttgaagtcgtcgtattcgctcaaatcgacattgtgacgcttcttcagggcatcctgacgggctcgggacttctgctcgttcatgagctcgcggaacttcgcttcgtcgaccttgaccccctgctcctgcgccatctccagcgtcagttcgatcgggaagccataggtgtcgtgcagggtgaacgcggcatcgccggaaacaaccggggtggtctcccccttggcttcctcggccgtgctcttcgccttcgcgacggccatgtcgaagatctccagaccgttggtaagtgtgcgccggaacgcgtcttcctcgccgtatgccgcctccgacacatcgtggaaggtgttggcgagctccggatagttcggttccatggcctgttccgacactggcagaagctggggcatgaccggatcggtcacaccgagcacacgcatggcttcgatggtgcggcggatcaggcggcgcagcacatagccgcgtcccgcattgctcggacgcacgccgtcgctcatgatcatgagcgcggaacgaacatggtcggccacgacgcgcattctgacgtcggcctccttgttctcgccgtacttgatgccggtgatcttctcggccgcctcgatgacggggtacacctcatcggtctcgtagatgttgttcttgccctgcagcaggtatgccagacgctccagaccggcaccggtgtcgatgttcttgtgcttgagctcaccggcgatgtgcaggtctgttttcgacttgacgttgtccaccatgtagttctcgaacacgaggtcccagatctcgatataccggctttcgtcggcgatggggccgccttccttgccgtattcgggtccacggtccacgtagatttccgagcaggggccgccggggccggggccgccggtcgtccagaagttgtcttccatgccgaggatctggatgtgttccggatccaccccttcgttgcgccacatggcacgggcctcatcatcgtccgtgtaggtggtcatccatagcttctctgggtcgaatccgaagccgccgtcttcgcgcggcgaggtcagcaggtcgtatgcgtaatggatggcctcctctttgaagtaatcgccgaaggagaagtttccgagcatctggaagaaggtgccatgacgcgtggtctttcccacctcctcgatgtcgagggtgcgcacgcacttctggttgctggccatgcggcggcttggcggggtctgctcccccatgagatacgggatgaacgggaccatgccggcaatggtgaacaacgtggtcggattgggcgagatcagcgatgcggacggcaccaccagatgatcctgctttttgaagtaattgagataacgctgtgcgatttcagcggtgcgcatgtgatgcgtctccttgtattggtgttctactgacgatattggcttcgcgtgtttttcaactcagctttgcggtgtattgccggttgagctcctcttcacgtgcctgctgggcctgcctgaactgatcgatgaggccctgcagtgtacgcatccccacattctcctgatccggccccaggaggaactgcctggctttgtccggggtgttggccctgacgtatgcggtggccttggaaacggcgagtacgcctagcaccacaccggcggcgacccaaaacactcgtttgaacatcactcgcccttgcctttctgctccgccgatgcgggctggtttttcttccctttgttcatgaacgacgccgctgtcaccttgaccgcgtagaaggtggatgccagcttgatgatcggcttgcccaggaaggaaccgtatagattcatcagggcgccgaggttgttcatcgtactcgaggccgccccggagatctcattgacgtcacccagtgacttgttgacctgcttgacggtggtcacaccctcgtccaatgcggggagagcatggtcgccggtctgtttcaccgtttcggcgatctgatcgaacatcttgcccaagcggatcagcgggtagatcagaaaaccggcaagaatcgcaaatgcaatcgccgcaatcagtcccgcaatttctccagcacccatggcgccctctttcctagcagtttgcgtctacacttatacgcgtttagcctatccaatcacccagacctaaacggctagcgtcgattatacgatatgacctcaatggcatcgtccagtgacttgacggtatcgaagtcaatcatggtcacggagccgttggccggtcgttcgctcaggtcgtaccccgcaggagcgaagcgctgcatcaacgacaacagcgtattgccgtgcgagatcatgagcacatcgtcgccgtccctaaggtccgcgttagctgcaatgagggcgaaggcgccatcgactctccgccagtactcctcgtcggactcggcgtcgtggaacgggtccgcctccttgaggaagtcccgggtggcacccagtccgaactgctcgactatggcatggtaggtgggagcaccgtgcgggcccccggctgcgagccaggccgctcccatgtcctgcccttcgaaatagccgtagaactgctcacggaagtgcatgtcggcatgaatcaccggcacgtcatgcccattggctgcattgatatcgagaatcgtctgtgccgtcacctgtgctctggtggtgtccgagcaatacgctgcggcgaaggtgatgtctttcaatgcattgcccgcatggatggcatcgtcgagtccggcttgcgtcaatggtgagttcgaccagccttggagacggttgtagcggttgaagaatgtctgtccgtgacggacgagatgaacatgcacgatcatgcttcgattatggcacggcgtgacgcccggacgtcgtatttcgcctgtggacgtcttcgggcataatggggtgatgggcaattttctcattcgatggttcattctcaccatagcggcggccgtgatggtggtgctgcttccaggaatgcacgtggtgggtcatccccctattctcggcattgccgccttctcactattcatggctctgttcaacgcctcgctcaaacccgtggtgcagatgctggcgctgccgttcagcgtgctcaccttcggcctgctggctttggtgatcaattggctgttcatggagctggcctcctggcttgccatcaatctgttcgacgtaggcgtgacgattggcggattctggtgggcggtgctcggctcgctcatcatgtcgctggtcagcggaatcgtgagcgccgcagtcggccaatgagacgccggcttgcgaatacgaagaggcccgcgggcaaatgccgcgggcctcttcgtgtatgtatgtccttataccgtatgttcctacagtatgttgatccagatcagcgggcgtagaattcgaccacgtactggatgttcacctgaaccggaatctcctccggctccggcttgcgggtcagcgtcgccttgagggaggcgaggttcacatcgagatagcccggcaccggcggcaggacgtcgcggtgggtgccttcggctgcaatctggaacggaaccatcgtctggctcttcggcttgacctggatggtctggccgggcttgacgcggtaggacgggcgatcgacgatgttgccgtcgacgaggatgtgacggtgcaccacgaactggcgggcctgtgcggtggtgcgggcgatgccggcacgcagcacgagggcatcgaggcgggtctccagatcggtgagcattgcgttgccggtctggcctgcggtgtgggtgcccttttcataggcggcgcggagctgcttctccgagatgccatactgagcgcgcagacgctgcttctcgcgcaggcggaccgcgtaatcggactcggcgcggcggcgggtacggccatgctcacccggagcatacggacgtttttcgaagatgcgctgtgccttcggggtcagcgcgatgccgagggcgcgggaaagacgcacctgacggcgggaacgattcgacatgatgtttccttcgttgttctgtcgttgtctgaacggaatccggcaaccatatggcgtcggactgagccagcctctccagtgcttcctcgtgccaagcacgaacagtcttgcgactgccgacccactgatgggctaagactcccagacagtgccccattgcataaggcaccaaatgggcattataccgtgaaggtgtagacttcggcgctccgatgccagatcatcagggctacagcttctcgatgggtgccagacgaagcataagtcgcttgacacctgtggagccgaaatctacagtgatcaccgagttcttgcccttgtcctgcgtctgaaccaccttgcccaatccgaaacggtcatgggtgatcctgtctcccacatggaaatccgcgatattaagatcattgtcggcggcaatctgcgaaatgggcattccctgtgattgaggtgtctttgcagtggtgtgcctggtatgcacggcacccgaacgggaagccgaggaacgggatgatgaggaacctccatgcgaccggtgggctccatatgcacccgtagaggatccggagcctcgcgagcggcccgaggaatacgatcccgaaccatatgcagtctggcccgaactcgatttgaacgtcgcggcgctcccccacccggtgcctgcagcggcattcgacgccgtacccgaggaaccgtaggcgtgggaaccgaaagccgaccccgaggaagtgcgggagcggcccgaggacccatagctcgagcgcccataggagcctgcaccataatcagaatccccgtcatcccatccgccgaattcgtcggagaagccgtcgtcgaaaccatcgttgcgccagccggaacgcatacgctccataccggcttcgcgacgcttccagtcgatgagggaatccgggatctcgtcgaggaactggctcggcatcatttcgctctgacgcccccactgcgcgcgcacggctgcgcgtgtcaggtacagcctgcgctttgcacgcgtgatgccaacgtaggcgagcctgcgttcctcggagagctcatccatgttctccatggcgcgcgaatgtgggaaggtgccctgctccatgcccgtgaggaacacaatcgggtattccaggcccttggctgtatgcagtgtcatcagcgtcaccttgccgctgtcatggccctcccccggcaactggtccgaatcagcgaccagcgcggtggtctcaaggaagcctgcaagggtggtatccggcgtgttctgctcgaactccgcggccaccgactgcagctgggaaaggttctccacacgcgattcatcctgcggatcctcggatttgcgcagcagctccagcatatgcgactgctcgagcacctgcgccacaatctcgctgggcttggagtcatgctctccggcgaatgtccgcagcgacgtcatgagttcacggaaggcgcgcaccgcattcgccgtacgggcactcatgccctcgatgtcctcaagctgctcgatcgcccaccagaacgtttggttgtgctcgttcgcgaacagcgtgagttgtgattccgcacgcgtgccaaggcctcgcttgggcacgttgaggatgcggcgcatgttgatgtcatccgccgggttcacgattgcctgcaggtaggcaatggcgtccttgacctcacgacgctcatagaacttcgtgcctccgatgagctggtacggaatatgcgcctgaatgagcccctcctcaagggaacgggactgggcattcgctcgatacatgattgccatgtcgctgtaaggcaatcccttctcctcatgcaggtggagaatctgttgggctatccaatgcgcctcgagttgtgcggtgtcggccgcgtacccgatgatcttgtcgccttcgccgagtgcggtccacagttttttcggcttgcgcgcactgttgtgggcgatcacggcattcgcggcatcgagaatcgtctgcgtggaacggtagttctgttcgagcatgatcgtgcgcgcatccgggaagtccttctcgaaatcctggatgttgcgtatgtctgctccgcggaatgcgtagatcgactggtcggaatcacccaccacagtgacccacgccggcccgctctttccggcctctgtggccatgggatcacttggttcatgggcatccacacccgcaagctcacgcacgagcacatattgggcatggttcgtgtcctggtattcgtcgacgagaatatagcggaatttatggcggtagtattcggcgacatgcggctgggttcgcagcagctccaccgtgcgcacgatcagatcgtcgaaatccacggcgttcgccagggcgagacgatactggtattcggcatagaccactgcatacaccggctccggatcgcctatctggccgaaggaatagtgacgcatgccgggtttgaaatcgggagcatactgagccaaggccgtgctcgcatcggtgagctggttcttgtagtcgctgattctggcgaggatggatcgcggggtgaagcgtttgatgtcgatattgaagtcagcgcagacgagcttgatgagacgctcgcaatccgcggtgtcgtagatggtgaagccagatttgagaccgatctgctcaccgtcccgacgcaggatgcgcacgcacgcagagtggaacgtggagacccacatgcgatcggccacgccgccgatcaatgcgccaagacgttcgcgcatttcggctgccgccttgttcgtgaaggtgatggccagcacttggcttggccatgccccgaattgggtgaggatccacgcgatgcgtctcgtgagtacgcgcgtctttcccgatcccgcgccggcgccgatcagcagagcgggcccacggtactgcaccgcctgggcctgctgctcgttcagatcgccgatgagctcttggggtggacgggcgatgaaatcaacgtcctgtggcaacgcatgtcctttctccacatcacgaattcggctttcagttgtaccacagtccatgttcaacacaacgccatggcccacccgtatgcgcatggtcatttgggcggcgtatgctatgcgccatacggacgccatgtcatggcgtgtttcacggtcagaacagcagagcaaagggtcgacatgcaggaacttgaagaacgtattcgagaacagggcgtagtgaaaccgggcaatgtgctcaaggtggacgccttcctcaaccatcagtgcgatgtgcggctgttcgaccatatgggtgccgcctgggccgagcatttcaacaacaagcacatcacgaagatcctcaccattgaggcatcgggaatcggcatcgcctgcgtcgccgccacccatttcgacgacgtcccggtcgtgttcgccaagaaggcgcagtccatcaatctcgacggcgaacagtatgtgacccacgtctactccttcaccaagcagaaggagttcccggtgatcgtctcgaagaagtacctcaatgcaggcgaccgcgttctactcatcgacgatttcctcgccaatggcaaggccctcaacgggctcatcgaactgtgcgaatcggcgggcgcgatcgtggagggtattggcatcgccatcgagaaaggattccaaggtggtggcgacgccctgcgtgaggccggctatgatctggattcactggccatcgtggaatcgatggatgccgagaccggggcgatcgaattccgccactgacagaacgcaacataccggctgtagcctgttacctgttccgcaacgaatacacgcatatcgacgtcgatcacgctggtatgcgtgtattcgttttggtatcgaagaacacagagagcaatagaagaaaagagaaacggcagaggaatgagcaacaacgccaaccccaccgcatccgacgccaacatgcgctcggatgaagatcaggaacgcacattcgtcacccccgagctgaagcgcgacgagcgtgaatccaaggcggaagtcgccgaggaaaagaggaaggggtccatctccttcgaagcgctgtccagtctcgacgcgcccgtctcgttctggaagggcatcccgttcggcctgcagcatgtgcttgccatgttcgtggcgaatctggcaccgatcttcctggtcgcagccgccgggcatatgagcccgcaggactccgccaagatcattcaggccggcctgctcgtcgcaggtctgggcacatgcctgcagctatacggcatctggctgttcggctccagattgccaatggtcaccggcatctccttcacctacgtcgccgccgccatctccattgtgagccacaagggctacggtgccgtggtcggcgccgtcatggtcggcggtctgctcgaggtggtgctcggtctgaccgccaggtactggcagcgttttgtgccacccatcgtctcggctatcgtggtcacttcgatcggattctcattgttgtcggtgggagccgagagcttcggcggcggagcgggtgccgaggatttcggcagctggcagaatctcactctcggcctcatctcactggtggcatgtctggcgttccaactgttcatgaagggaaccgccaagcagctttcggtgctgttcggactggtggtcggctatatcgtggccatcttcttcggcaaggtcgacttctccggcttctcgcacctgcaggcggtcaacgtacccacattcatgccgttcaggcctgagttcgactggggctccatcatctcgatcgggttgctgtacatcgtttcctcagtggaggtgctcggagacacggcagccctgaccaaggtcgggctcgaccgcaagccgactgcaaaggagacatccggcgcgattgcgggcgatggcctcatctcgtccgtctccggtctcttcggctgcctgccgctcacctccttcgcacagaacatcggtctcgtggcaatgacgaaagtggtcaaccgcaaggtgattctttccggcggcctgctcctcgtactcgccagcttcgtgccagccatatccgaggtgttcaattccatgccgcaggcggtgctcggcgggtgcacgatcatgatgttcggcaacatcattctctccggcttccaaatgatctccgatgccggatacacccagcgcaacatcacgatcgccgcgctctccctcaccataggcatcggtttcacgcaggtctccagcatcttcgtgcatttcccgccgctgttccagtcgatcttcgcgcagaactgcatcgccgtggcatttgtggtggctgtggtgctcaatctcgtcctcccgagcgaggaccgtttcctggctactcctgcgaccaaccggaagtgaacggaatcgggaagaatccggatgaatgcgaggggccgacggtgtaatgccgtcggcccctcgcatttcacacggcggaagattgcatatgccattccccacacgcatgccgatgatgccaacttcgaatgaggcgacgacgaaatcgaggaatccgcaagtgccgcacgcgtattgtatgagatacacgagtctgaaaagatgctatgcaagcgattacgcaacagctgctcagtggtgaacgcgcactgttccaaggtcgtgatcttcagatcacggattgcgtgttcgaggacggcgagtcgccgctcaaggaatcacgcaacatcgtggtcagggattcggtgttccgctggaagtatccgctgtggtacagcgagggcgtcgaggtggagcacagtctgttcgaattcaatgcccacgcggcgttctggtactcgaagaacatgacgttccacgactgcaccatccaggcacccaaggaattccgtcgcaatgagcatgtgaccgtggagcgcaccgcattcactgatgccgcggagaccttctgggaatgcaggaaggtcacattgcgcgaagtgagcgccgccggcgactactttgccatgaacagtgagaatctggacatacgcgattttcagctcaccggcaattactgtttcgacggcgcacggaacgtgacggtggatcatgcccgtctgatttcgaaggatgccttctggaactgcgagaatgtcacggtgcgcaactcgttcatcagcggggagtatttggcatggaacacgaagaacatcacattcgagaactgcaccatcgaatcgctgcagggactgtgctacattgacgggctgacgatgcgagactgccgtctgatcaacacgacgcgctcgttcgaatactgttccgacatcgacgccgacgtcaccacacgcatcgacagcgtggtcaacccgatttccggcgtgattcgcgctgccgcattcggcgacgtcctgcagaacgaccccgcgatagacacgacgaagatccagctcatcagcacagacctatgattcacggagcagcgaggcacaacatggacattgacgagcgcattgcacaattcgactcccctgtcgaccgcacgggcatcttctcgatgaaatgggacgtggccgatggggagttgccgatgtgggtggcggacatggatttccgcacggctccggcgatcagcgaggcattggctgaacgcgtgggcaacggcaccttcggcggatgttccccgggaatggaccgaagcggtcgcggattggtcgctacgccagtatggcgtgacggtggattctgagcatgtggtgttcaccaccggtgtgattccggcgatctcctcgctggtgcgctcgctgacgaatgtggctgagaaggtcgtgctccaaccgccggtctataacatcttcacgaattcgctagtgaacaacgtacgtcgtgtactgaacaatccgctgcgatacgagcatggtgtgtgctcgatggatttcgaagatctcggacgcaagctcgccgatccgctcacccgtctgatgattctgcgcaatccgcagaatccgagtggcaacgtgtggagcgacagcgatctggcgcgcgtaggggaactgtgtgcaaagcaccatgtgacggttgttcccgatgaggtgcatggcgacatcgtgcgcccgggcgtcacccatatgccattcgccgcggtcaacgagctgaaccgttcaatctgcgtgacctgctcgtcgccatcgaaggccttcaatgtggccggactgcagtccgcatatttcatctgcgacgatgacggtctccgggcacgtgccgtgcgcggcgtgaacaccgacgaggtggccgggccgaacgatttcgccgtgttctccacaatcgccgcctatgcagatggaggcgcatggctcgacgatctgtgccgtgtcctgcagcgcaacaaggactacgtgtcgacgcaacttgacgagcatgcacatgacatgctgcatatggtggcctcggattccacgtatctggcatggatcgactgctcgggccttcttgatcgtgtgggtgacgccaatgctgagcgcttctgcggttttctgcgctcacataccggtcttgtgctctcgtatggcggcatctatggcgaaaacggatcccggttcgtacgcatgaatctcggcacccgcgccgatctggtcatcggcggcacggcgcgcctgctcgccggcgccgcggcgtatatgggaaactaatcgaaatcaggttcgtaccgccgccgcgcatagcggatcacgaaccaccgcatgcacaaagcgatgccgatcatcacaacgagtggaagccagaagtactgtgaacggaaggtgggcaggaagtaaagccccagcgctccgagcacaccgatggccacggtgaagttggtgagcgacgacgataagtcgcatagcctcttctctccgagtctcatctcacggcgcgcatcgctttcgcttttccccagctcgtagacgttgacttggcgcaacgcacggaaattatagaggaacagatcggtgcgcgttgcgtacagacccccatacacataacaccacacccccgccgcgatgctggtctgcgcaatgccggcggcgatgccgtcacccatgccatgaccgtaagccagcagcaggccatgggtgacgagaatcaccacggtgcccagaaccaccagaaccccgcagcgaatccacccccggcgcctctgcgacactgtgtagaactgctcgatccgattgaatgcggcgtcgtattcccggctgtcctcatgcgcatgcttgagaatcgtgtaaccgatcaggattccaacgatttccgcaatgaacgattccggatgccgctggatatgcggcagctccaccaattccttggtcatgaggccaatcagccgatcgagccctttgaccacctcctgcacgtcggcggtgttgcgttccggcaatgcctgcaggaagcttccaagggcgaatccgagaatgatgacggtcacaccatttgcgatgctcagggcccggttggtcgcatgcctgtcatagccgaagcggtcatcctcctcggctatcgcctgcatccggtggacttgtgcgcgtattgccgcattgtgggcgtgtgctgccaaaccatcctgtgccctggttccgcttcctggattctgcgtatcgggagacactggtgaatctgcaccgcccttgtgttgcttcgtcattgtctccctctcctccccggtgtcaacctctacagacattagcgcatagctggccggttattcttagtctagaggcatagactccgcttgtggcgcacctatgctctcaggcgcatacagtcccagctgcgggcgtgccggacaacgcttccaacatcaccccataatcgtccgcatcaatatagatggcgcatgaccgcggagggcatcgcatcatgccctgcccctgcgtgtcagtcgtcgccggggcatcaggatggcatacgtcgataagcgtgtgcgaggcgagcgccgcattgcgaacctgtcgatggacctcgctgctcccggtgttgagcaccacgcacaccgggtgatttccttccaccacccagcacagcgaatgggcggtatcgcctggctgcgcctccacctgatcccccagcagatgcgcgcggatccacaccatgtgcggcaggaacctcattggcgggatgagatcgtggggtacgccgtagtaatcgccgaagaacacgcaaggcaacacgttgtcgcgtagcagaatgcatgcgtacgccaacggtttgaaccatggttgcacccaggattcgagcgcctgaccgggttgtgtgtcatggttgtccacgaaggtgcatgcatacgtcggttcacgctcatacagcgtgtctgcggcaagtccccgcagatcgaatccctctgggttctttgaggcctgttcgaagcggaaatggagcgcgacatcgaacagcatcatgcaatggttgcaatcatgcaggtacgaggtcagctcgctcgcgtcacccgaccagtactcacccacggcaatgccgggatgattgccgtatcgttgcatcgtgcgcaaccatggcgcgaagaatccggcgtcgatgcttttcaccgcatcgagccggaagccgtccactcctgtggtcgtcgtataccatatgccccaatccgtaagctctctggcgacctcaggttcgttgacatcgacgtcatctcccatgatgtaatcgaagttgccgcgttcatggctcacattgtcgctccactgcttgccgtcgaaacgcatgatgcccgtcgtgccatcatcggtcgtgtaatcggtgccggtgaaatcgctccagttccatttgaatgtcgaatacacgccgccgcgttcggggaaatcgtatacggtgttcaaggtgcgttcgaccacggtggagtcgcttctcgtgcggtcgtccacattcacttcatgtgtgcgcacgggttccgttccatcggcacccatgcggtggttgaacacgatgtccgcgaatacacgaacaccattgccctgcatcgcgcgaatcgcctgaaggtactccatgcgggagccgtatttggtgggaacagagcctttggcatcgaactctccaagatcgtacatgtcatagacgccatatcccacgtctgaatcgccggcctgccccttgtacgcaggtggaagccaagctgtggtgaatccggcatgggccacgctcggcgcctgcgatgagagccatctccataggttgtggctttcgggcaggtaccattcgaagcattgcaacatggtctcatggtttggtttgtctatcgccatatccgttcgcgtccgtaggtgtcgtcagttgccgtgtcctgttgcctccatgctaacgacatttacatccaatacgcccgtagcttgtggcatattggattggcccgcgcactgccacattcaatctcggagtgtgcaggcgttcacgaaggagcggaatatgcacctgtttggttcgtctactttatatagatgttcaggatgccattgcacagcacgatagaatgcacttcgaggcctgtagatcgcttccacgagaccatcctcgctgatcgccatcggatccaacccctcgcccagcttgcagatggcctgatgatgccggctgttgaccgcaaggtcggtgtcgtgtaaatcttctcgcaggggcgtcctgcttagaatgtgcacatggtgggccggccgaccatagggtgggtgctgatgatgatcgacgtcgctgggatgttcgctcggcagatcctgatacagcgtccctccgcagaagatgttcatgatctgcagaccacggcatatgccgagcaccggtttgtcgcttgcaacggcacgttcaagcaacgcgagttccatctcatcccgcgcatcgcagcagtgcagattgccgtatcggtccgattcaccgtagcatgccggattcacgtcatgcccaccagtcatcacaaggccgtcgcacatgccgaagatctgcccgatctcctgtcgatcggtcgtcaatgcaggcatgaacggcactgcaccggcctcacgcaatgcattcatgtacccgggaagcatccataggctctcccgttcgtcatccaccaacggcatcaccgcgactactggcctcatatgccctccgttccctcatcgtcatgcagacatggacatgagcacgatagccaagagaggaacattctctgtgacatgacgattacgaatccatttcagcatcgaggtgcgtggatgccaacccggtcgtaatccgcatacctggcagctccgaagaattgcgcggcttagatgaacctgtaaccgtggcccgtgtgcccaatgaacctgagcagatccccgtattcgggactcatcgccttcgtgttcgtattcggatgcatgagcagacgctgtcctgcgagcgcagtatcgaccagcacctcgacctgttggtcggcatcgttgatgagtgcgagcggagtcaccgatccgggttcgaggttcaatacgcgccgcagatcgtcggcattcgcaaatgagagccggcccgtaccgatgatctgtgcgagagccttgagatccgctcgccgatcctcgctcatcagcacgagatagtagtttccttttcgattggtgaggaatagattcttgatcggggtgccgtcgatgagcgttctgacgaattgtgcggcctccattgtcgtaaccgcggggtgtgtgacttcggtgtagtcgatgccgagttcgtcgagagtattgtagagcgtcacagtggtgccgagcatacccaagccgcctcccaggcatgccccatgccatgataagcccctcatgcccctgtgtgcatgatggtgtctgcatcacaaccacagtctccgacaatcaccattcggctctgctgagtaggcgatgggatatcgaccctgatgcggccgtgcacaccaagcagacaacaccgccaatcagcatcagcaggccgtccggaatggaggtcagggcgacaaggatgtcctgattgtttgtgacggaaacgacgagtacgcatatcgtaaagatgacggccatcgccacgatgcgcatcaccgcggcacggtcacggaaggcgagaatgatagggatttcaaccgccaccgtcaccgacaccgtcgccaggaccatcaccaaggcaacaggcacctgattccatgccatctgcgggctcaatgtgccaagggccatgagcacaagcgacaggagcatcggagggatgatggcgccacagtatttctcgatgagataatcacgggtattaaatggcatcgtgaagaacatgcgccgacatgcccgtgacacgtcgttctgcactgtcctgcataccagcattgccagcatgagcggcaggaatgccacaccgaatgcatggaggtcggagaataggtagaacacggtcaacgccagcatgcacaccagcagcatgcgttgcttgccaagccagattgcgtctctgacgaacagacctttcattgcattgtcctttcctgcatcgttgtggttcgcgggtcggcactcatcagcgtgatgatctcatcgatgctcgccccacagatccccactccgggcaagttctcctcatagaatccgcgttcgtcggtaatggctttccagccgccggccgtgcgctgtttgacgagtatgtaccgtgggtctgcagctgacatctgatcgtcggtgagcgtgagcaccgcatattcatcgtgcaatgcatcgatggtctcgtgcatgcggattcggccgcggtcaatgaggtagaggtcgtcgcacagattctccaggtcggtggcgacgtgcgagctgatgagcattgaacggcctgggatctccatgtattcgcggagcaggtcgagcacttcgttacgggcgatgacgtccagaccggccgtcggctcatcgaggatcagtggttcggggtgatgtgccattgccatgatcgttttgcattcggcaagcatgcccgcggagaattcctgaatctgctggttcagcggaagcgtgaacctctgcagctgtgccctgcaccattgttcgtcgaatgtcgtatagaagcgtttgcgttcggcgatctcatcgttcagcgtgaaggtcggcacgaacgtgctgtcgccgaaggtgacgccggtgcgcgatttcgcgttcacccacacccggcggatgggatcaccgagaatgatcccctcccctccagccggcctcgcaagtccgagcatgagcctgaatgtggtggtcttgccggagccgttggtaccgatgagagcggtgatggtgtcgtccggcacctccatcgtcacgtcgaggtcgaaatccgggtagtgcttcgtcacatggtcaagtgcaatcttcatgatgctccttcagtcccttcgggggcgtcgcccgaatccgcggaggtgtcttcaagcagcatgacgacaagctcgaggatctcctcgcgggtcagcccaagccgccgggctttggcgatagcctgcgcgaattgctcctcgacctggcggttgagctcctcggcgacgatgttcggcgagatctgcgcgacaaagctgcccttgccctgaacggtgacgacgagtccctcccgttcaagcacgtcgtacgctttcttcaccgtcagtgcggagattctgcaggtacgagcgagggagcgaaccgaatccagcggctcccctgccttgagtctcccctctttgatgagtgcacgaatctgatcgacaatctgttcatagattggcgtcatcgacgtggtactgatcagaagctgcatctcccctcctttcgaacgcgagaatacaatgtgtccaagctcgatatataacagtatataacagatagaacagtgcatatctctgtcgtgttggctcacaggcatgttcacagacatattgcgcgacattccatatgacgagatgtggacacgatgatgaaagacgtgaacaatcattggaattccagcaatgcaaccgcaagttgacatcagatcgccggttgtcggagcaaatgcaaccgcaagttggtggcgcgctttccgcatttcgggcatagtaggggcatcggcacccgcgacggttgccgaaacgagtaggcgcgaaggaaaaggacaggaccatgggcttcaaagacaatctgcagtatctgcgtggatcgcacaatatgacgcaggagcagctggcaatgctgattggcgtgtcacgacaatccgtgagcaagtgggaaagcgagaaggcgtaccccgaaatggacaagctgctcatgctatgcgatatgttcggcgtgagtctcgatgatctggtcatgggtgacgtgcgcaatggaattgccatgtcggcgaatcatgtcgaggatgggctcccaaaagcaccgatgcctgagatggaagggtcggcgttgcctcaggacatcaccggctacgaggagcacatgcgcaaattcgacctgatgattcccacgggagtgtcagccatcatcttcggcgtcagcatcggcaacctgttcgattcggacaattcgattctgggcaacagcgatgcgaatgaggtggcgatgttcctgtgcatcgccataggcacgctcgtcggtctcgccctgctcattcccgccggtctggcacacagcgcgttcaaacgtcagcatccctatgttgaggacttctataccgagtcggaccgtgccgccgcccgcaaggtgctcgcgatcgcactgatcgcaggcatcgcgctcatcatggccggcatcgccgtcaacgtatgggccgatgagacgctccacgtagacgagggctggcccagtacggcgctcctcatgttcgtcgcggtcggcgtgtggtgcatcgtattcggcggcatgcagtatgggcggctcgacatcgccgactacaacaaggaatcggaggagcaacacgtgcaggagaatgggacggagtcaatctacgacaaggggaacggagcggtatgcggcatcatcatgatcacggcccccatagtcggcctcacgttgctgttctgctttgacggtggaccgcacggcatgttctggatgtcctgggtgatcggcggtttcctctgcgcaatcgcctcgattgtcacaggactcatcaaatccaccaaatccgtctgaacggcgccccggcacaacatggagtgggtagaatattggaaaccgatatcgcaatggaacgaggaacatggtggacgggaaaatcaggcaggcactggagacgatgccgaaaagcgaactgcatctgcatatcgagggaacgctcgaaccggagcttgcactgacgctggcggaccgcaatggagtgacattgccgtggacggatatcgacggcctgcgagcgcagtatgaattcgagaatctgcagtcgttcctcgagctctactatgcgctgatgaagacgctgaagaccaaggacgattttaaggatctcatgctcgcctatctcacacgggcgaatgcgaacggggtaaggcatgcggagatcttcttcgatccgcaagtgcatgtgtgcacgaacggattggatttcgacatggtgctcgacggccttcttgagggattggaaatcggacgggagcgcttcgacatcagcggcggtctgattctgagcatcgtacgcgacatggatatcgattcggcgaaccggatcctcgacatggcggcgccgcgaaaaaccgagattctcggcatcgggctcgattcggcggaagtcggctacccaccggccgaattcatcgatcagttcgcgcgggcaagggactttggctggcattgcgtggcgcacgccggcgaggagggcccggcggcgtatatccgcgatgcgctcaatctgctgcacgccgagcgcatcgaccacggcatccacattcaagacgaccgcgagctgctcgagcgcgtcgcacgcgacggcgttccgctcacctgctgcccgttgtccaacctcaggctgcaggtcgtacacgacatgcgcgagcatccgattcccagattcctgcatgaaggggtcgtatgcacgatcaactcggatgaccccgcatatttcggaggctatgccgcggcgaactatgccgcgctcgccgacatcggtatgtcgatggaggaattggcatcgctcgccaagaactccatcgacgcatcgttcgcctcggatgaccgcaagacacagctccatgcgcagcttgccacatggcggacacaacatgggctctaatcattccgctacatccacatcaatgaacaatcgcatgtgatgcatcaatgaatcagtgatgattccgcgcagcgcatcgccatattgtctgctgagattcaacaccagatcctgctgtacgtcgttccaagcatcgtaaggcagcttgacgccactgccggtgatgaaatcacagtaataatatccgtgttcatcgaatcccgcatgcacggtcaccacgccgcccatgtagacgtccacgtcatcatattcaaccggtcgtggaggatggctctcattgcacagttcctctgccctgtcatacacggacaatgggaacagttcgatctccccgaccaccgtgattttcctgtcgtgattcgtcaaagaaggaaggcccttgcgcagataatccccgtgactgccacatgtgggcatatcagtggcagcctcaagacgttgcctatattccttgccaaaccaatgcatatacagtttgctcagcaccatcatgcataccgggtattgttcattgcccacaatcactgcatcgacgccacaatacgggcacaacgcagtgtcctcgccgtcgtcctcctgcagccattgtgcaacttcgttccctgcgaatatgccaccgcagtggaaacaaccgcagcgcgcggaatactcgaccatggctcggttatgcgcggtctggctgttcagctcgttttcatcgtcggattccatgggaggaatgcacaacgacggatcatcaggaagaatgcttggactagtcatgattcagcaccatagtatgggttgccggtttccaaggatgcgcgcagtaaccgccgcaaggagcatgccataccgcgcgcacattcatcgcgtgtgagccgaatgaactgttccccagagcatcgaagcgtctctgcttgtgctcgttgcataaggttatggtatcgaatagcaatccatatcggcatgttttgttgtatcttccgtaatccccacttataagaggagaccgccgtgcagtgcaacagtctggacgaagtgcgttcgcacatcgacgccatcgatgaccagaccatcgcattgatcggtggacgaggccaatatgccgtgcaagcatcggcattcaagaaagatgaggaaggcgtacgtgacaccaaccgtatggagcgggtcatcgcgaaggtgcgaggtaaggccgagcgttgcggcgcgaatccggatgtggttgaggcgatctatcgcgagataatcagcagattcatcaatatggagatgcgggagttccatgaccatccatcaccgacacccgctgaggcgtaagaagcggcatacggcatatcattcaccggcctcatatgttcgacgcgcaccagcacatgcgcttgagcgcatcgaccatccatggactcaaaacaacgattcctccagatctatcatgaattcataaaagacgacaacatgctcccgagcgagttgtatatcgtttcatttcgatatatcactatatatcaccttatattcggttatatcaccctatatacatggacatctgcacatcccacatatccttcgccgtaccatgacatcatgagcacatatgagatgcgaacccgtctgatcatcgtcgaagggctgccagatagcgggaaaagcacgacggctgcgatggttgccgccgaattggaagcgcgcggaaggaacgtcgtctgcgtcgaagaaggagccgcagaccatcccgccgatgtcggcgaccacgacttccctgatttcgcaagtgaacgcgccacgatactcgatacttggcgcgcgttcgcagcccacgccgaacctgatacgacctatgtattcaattgcgtcctgctgcagaatccgatgtgcgagacgatgatgcggttcggcatgagcgaggacgagtcacgacggtacatcagcgatattgcggcgatcatcgcgccactgcatcccgtcgtcatctacattgacgaaccgggcgcgaaatcggcgattgacggtgtcctcgacgaacgcggtgatggttggctcaatgccgtcatcgactaccacacagcacaagggtacggtgaagcgcatgggttgcgcggatatgaggggtatatcgcgtgccttgaagagcgcagagagcgggagctgcgcatcctacgttcacttccggttgacagccacatcatcccgccgtcgagcgatgccaaacggatatcgacggtggtggatgcgataccgtgacacggacgcgccctacagccactggatgaacgcggtcttgtcggtgctgctgtagccggcgtggcggtagaaatcgagtgtcttcggatcatgggagccggtgagcagcatcatcttgtagcagccggcctgctgcgcgagcgccttcgcatggttcagacatgcggtagcataaccatgcccacgcgcatcggcgcgcgtcacgacgttctcgacgaacgcgtatggccgcacaccccgcgtcagattcgggatgatgacgcatacacatgaggagacgatggtgccctcgcgctcgcatacgatgagacgacggaggatggagctgacgggaatccacttttgtaagttcctcccccaccaagcagttcgttcaccgtgatgcccagtatgtcgcataacggtacatgatgaacgtcagacatgctctggcccgccccacttcaagaccactcaaaacatcagcgagcgcttgcaccagctctgccttggatgtggtatggacacgcacaccgcggcgcgcggcggcgtcttcaagcgcgtcaaccatctgcggacgccgctcagcgggaaagtcgatgatgtactgacggaactcctcatcgaattcgtgttcgacccacggcatgtcttcgcgcttcataccgctacatccctcgacgccctcaagacatacgtcggtcgggaagtcgaggaagaacacggtgtcgcaatattccagtcgtttcggcagcgtccgcgcgaaattgccgtcgaggatccaggcatcctcctcgaggatcctttgcaaccgctcatcgaattcggcccgtgtgacagtcgtccggtccggattgtgccacagcatgtccagataatgcagcggcagtccggccgcatcccgcaacctgcgcgcgaacgtgcttttgcctgcacccggacatccgatgacaagcacacggcgcataccactgtatcccgtaaccgcatccatggttgtcgatcatcacaccccattcactcgcttcctgcaaccgtataccccatatcctctatatccacttaccggctgcactttcttacgggatgcaccctcaaacagatccgtcagttatacccgacaaaccatcttgaaatccgagaaatgtcagttatacctgacaccttcagcggtttgtgacacatcgcaagttccacgccgaagaccccggactatgcaacatcgcaaatggtttctcctcacaaaactacggattccaattggagaacgtcgtcgcgaacgagctgcgcagacgcgggtacaacgtgcatgtcggcagtctgcgtggaggtgaaatcgatttcgtcgctcaacgattcgacaggagaatctacattcaggtcaccgggacgatgctcgaagaatccacccgcgcgagggaactcgcgcctttgcaatcgttatcggatgcattcccgaaaatcgtgctcacactcgacagattccgtctcggcacgacctctgacggcattgagatacgcaatatcgtcgactggctgctcggctgataccatatcgagcccattgccgacaatcggattatgtcactttccggtgccggtcacatgttcatgatttgccctatcgactgcgggcgcgcttctagcggatacggatcgcattcccccctccccttgggaggcgtcccggttcgggtcttcggatggattcgacgtcatggcgtcccaccttgaagcccgcatccaaatcgatgtccacgtcgtaatcgtcgtccggggcaccttccatgagaagaaactggatactggatagcagaacgacgacaggtggcgcccgccgaagataggcttcggcgggcgccacctgcaaagaaagacgctatgggagcgatggtcgcatgatcggcggggtcactcccattcgcaaaatgaaacttaattctaaacgcttttgtttgggagatttgatatcatttgatttttcctgatacctattatccttatcctatgggcttgccgaacttttgctatcatttggctatcaaggaaatggctatcaacggtaaaattagattggtttctctggtggtttacaactacattttaccacgaaagacagggaaatgcaataaccttcctcgctgtggtgtatcaagtgatcttactgaacatatggcgcaccttgtccaggcggctgtttggacggcggggctggatgactggcttgccgacagcggcctgataccctttcagttctgtaaggcatacgctctgcccgttggtgtaaaaggccagatcagtacggtatgcctgtatacagcgggcgggaatctcgccagtaaagacaacttcatccttttttacctggaccgtttcgatggtggcacagtatttcggtgcatcatgataagccctggaaagatattcccggggcgcatagagggtgaaggagagataaggttccagcagttgcgtccctgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctcttgtattgtacaccggagccaagcgggagtggtgtaacagacagtccgatggatgcccaaaacgggttgggcggcacctcgatatggatggtgtggctggctgctttgagcggccgctccatataaatgacggtgggttcctttaccactgtttcaagcttgtatttttccgacagcaaagcggaaacaacctccaactgcacccggcccaaaaaagaaagaatgatctcatgggtgatggaatccacctcgcagcgcaaaagcgggtcagtatccgcaagttgcgtaagagcgtccagcagccgttctctttgcgctgccgttttcggcgcaatcgacgtccgcagcatggggagggggtcctcacgccaccttttacgagggagccgggttgggtcccctaatacatcgtttaacctcacgctgtcgctgggaaggataacaatttcacccggataagcggtgtctgtccgaacaatttcccctttggatggaatacgcatctctgtgattttcagcttttctctcccggccagggccaccgtatcccgcaggcgcagcgttccgctgtatagccgtagatagacacgccgctggccgcaatctgtatactccaccttgaaaacgctgccgcatagggcggcgctcccctgttccccaatcggttggaacagccctgtcaccgcatccatcaacggttgaatgccaaggccctttttggcgctgccataatagaccgggaacagggaggcgtcttgaacccgccgctgttcctcccgcacaagtttttcccggctgattggttctcctgcgatatacttttccaataatttatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttgactttacatctgtgccactggaaggaagtgactgccgcttgaatggtaatcccacgctgccgctccaaaagcatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttactgccccgaagggcataaaaatccccagcagtaaaatacttttaccactggggatgataatttgcggacatacacatatacagcatacacctgtttgtgagtgctgtttttggggatatgtcaaaattgataaggcaaaagtattcttaaattgggtacaaaaaactaagcccctacaaaagggactatcataatcctttgttcccactatttgattatagttttatttaaggcaacaccgcacaaatgccacaatccgcattatacagcaggtgccgaataaaaactgtggataacctccgaattttttgtccgcaaaggcgcactgactcaagctgccagacagggtctgtcagccagaatcagatttgccaacgcaaacatgatattgaatttggcttgttgcttttcaagccctcggtatcgcgtttttcggaagcgcagctgcttcttaacgacaccgaatacatgctctacttttgctcgcactgaggatttcgcccgttccgctttctttgctgcgtactgcccgcttttgctcagtttcttcatctgcgatggacgacgattgatcttgtacttgattttccggccagctttgtttcggactacggcatcttcgcgcttacctgcgccgagataaccgctgtctccatagactgtttcttcctctcccgtcaataatttcggcacttccgcaacgtcgtggacatttgccggtgtagcttccactgtgtgaaccagtccgctgtccttgtccacgccgatatgcgctttgtacccaaagtgccaggtgttgcccttcttgacttggtgggcatccggatcccgtttcttttccttattcttggtagaagagggggcggaaatgatggtggaatctacaatggtgccctttttcagaatgaggccacgttccatgagcgctgctaccacctgagcgaacagcttctcctgcagtccgttcttgatcagcaagttccggaaccggccaagagtatccccgttcggaacctggttgctggaatcgacgccgcagaactccgaaaatgcgcggctgtcgatggcttctgccaccgtggcctcgtcactcaggtcatagaggttttgcagcagatacagtcggagcatgatctccagcggatagggtttgttgccgcgctctcctttgtaatagcacggctgaatcatggcaagccattccttccacgggacgatccgttcaatctggtcgagaaatgcttttttcttcgtccgcacctgtgccagttcgtcgctgaatgcggaaatcgtcatctgtttatccataagtttgttatatcacacttggcgatatatggcactttttttctgtgcggtattgccttagatgtatcgccccaggcgttgagcgtcccggacatagacaactacataggtttggcccatacgctgttcgccttggaggatgtttacagtctgaaagtggtagaggcggatggacgtgcctgcctgcaagcagatatttttcagggaggccgtcaagccagtgagctgaacaaaatcttgattgcgtggcgggaacaggcggcgaagttggaggccggggagatcaccaaggaggactatgaccgctggcgctacaactacccgaagtacgacaccacccagcggtgggccaaagtcccctcgaaggaattaagcgatgctctgataaaaggattgaagaaacagagaaaagacaaataacaaaaaaggtcttgccgactggtgaaagtcagcaagacctttttcttaggatatggaggatttacccgcaagccacccgttatacgggagtgaacaaagtaaatccggttttggtatctgctatcaatttgctatcaaatgccccgtttccgctttaagaccccagtgttttcaaggctttgcgggttttgtcagttattcccactcgattgtcgccggtggcttcgacgtgcagtcgagcacaacgcggttgatctgacggcattcgttcgtgatgcgagtcgagatggtggcgagcacgtcgtacggcacacgcgaccagtcggcagtcatcgcgtcctcagagctgaccggccgcagcacgatcggcgaaccgtaggtgcgttcgtcgccctgcacgccgacggagtgcacgtcggcgagcagcacgaccgggcactgccagatgtcgcggtcgagaccggccttcgagagctcctcgcgggcaatcgcatcggcatcacgcagcaagtcgagacgttccttcgtgatctcaccgatgatgcggatgcccagacccggcccggggaacggttgacgccagacaatctcgtccggcaagccgagttcggtgccgatggcgcgcacctcgtctttgaacagcgaacggagcggctcaatcagttcgaacttgatgtcgtcaggcaaaccaccgacgttatgatgcgacttgatgttcgaggcgccgtcgccgccaccggattcgacgacgtccgggtaaagcgtgccctgcacgaggaacttgacctccttgccctgggcaccggcctcctctatcacctggcgctgcgccttctcgaaagtgcggatgaatttttcgccgatgatcttgcgcttcgtctcaggatcggagacgcccttgagtgcatcgaggaaatccttggaggcatcgacggcgatgagcttgatgccggtcgccgcgacgaaatcatgtttgacctgctcggcctcgcccttgcgtagcagaccgtgatccacgaacacgcaggtgagctggtcaccgatcgcgcggtgcacgagcgctgcagccacggccgaatcgactccaccagacagaccacagatgacccgtgcgtcaccgaccttctcacgaatcgcagcgacctgctcgtcgatgatgttccttgcgttccaatcggcttcgatgccggcgcaatcatgcaggaaattctcgatcagatcctgtcccaacggcgtgtgcttgacctcaggatgccactgcacgccgtagagtttgcgtgagggatcctccatcgcagccaccggcgccccttcggtatgcgcggtgacttcgaatccggcgggtgccttgttcacggcgacaccatggctcatccaagtggtctgcagggatggcgaactgtcgagaatgcccgtggcatcgtccaccaccgcctccgtcttgccgtactcgccgagcgccgccttgtcgacgtcgccgccgagctcatgggccatcacctggaagccatagcagatgccaagcaccggcactccggccgtgaagatgctcttgtcaatggtgggagcaccgggttcgtacaccgacgccgggccgcctgacagtatgatcgcggacggcttcttggccagcatctcctcgaccggcatcgaatgaggcaccaattcggaatacacgttcgcctcgcgcacgcggcgcgcgatgagctgcgcgtactgcgctccgaaatcaacgacaaggacaggacctgctgccattacgctccccttatatataggttcattactcgggcattacaacacatctattgtgcgcaggcaagtagacattgaaattcgcacatgccacgggtcgcatcggtgtcgtcttaagcgctcaagcactgcaatcacaaggattttccagattgttcgcttgttttcaacacgccgcgcaatatcctcacaaaccgcacgcgacaacgacggcgaaaacgcttgcattcgttggtatttcaacgtttctcgcctttattcactgattttccattttcacaaatcgcccgagcaatctcccaaattcgcaaattatgcgcacagattcgctcacactgtttcaaaaactgcaaaaaggtcagcgtattcgcgtaacataatcagcgatcgggcacggagaccggcctgcaggacagcgccgaagcccgtgcccaacggaataaacaaatcgcacatttatgtgcaggagtacaggagcacacatgactaatcctgttattggtaccccatggcagaagctggatcgtccggtttccgaagaggccatcgaaggcatggacaagtactggcgcgtcgccaactacatgtctatcggccagatctacctgcgtagcaacccgctgatgaaggagcccttcacccgcgatgacgtgaagcaccgtctggtcggccactggggcaccaccccgggcctgaacttccttctcgcccacatcaaccgcctgatcgccgatcaccagcagaacaccgtgttcatcatgggtcctggccacggcggccctgcaggtaccgctcagtcctacatcgacggcacctacaccgagtactacccgaacatcaccaaggacgaagctggcctgcagaagttcttccgccagttctcctacccgggtggcattccttcccacttcgctccggagacgccgggctccatccacgaaggcggcgagctgggctacgccctgtcgcacgcctacggcgcgatcatggacaacccgagcctcttcgtcccgtgcatcatcggtgacggcgaagccgagaccggccctctggccaccggctggcagtccaacaagctcgtcaacccgcgcaccgacggcatcgtcctgccgatcctgcacctcaacggctacaagatcgccaacccgacgatcctcgcccgcatctccgacgaggagctgcacgacttcttccgcggcatgggttaccacccgtacgagttcgtcgccggcttcgacaacgaggatcacctgtcgatccaccgtcgcttcgccgagctcttcgagaccatcttcgacgagatctgcgatatcaaggctgcggctcagaccgacgacatgacccgtccgttctacccgatgctcatcttccgcaccccgaagggctggacctgcccgaagttcatcgacggcaagaagaccgaaggctcctggcgtgcacaccaggtcccgctggcttccgcccgcgacaccgaggcccacttcgaagtcctcaagggctggatggaatcctacaagccggaggagctcttcaacgccgacggctccatcaaggaggacgtcaccgcattcatgcctaagggcgaactgcgcatcggcgccaacccgaatgccaacggcggccgcatccgcgaggatctgaagctccctgagctcgatcagtacgagatcaccggcgtcaaggaatacggccacggttggggccaggtcgaggctccgcgttccctcggcgcgtactgccgcgacatcatcaagaacaacccggattcgttccgcgtcttcggacctgacgagaccgcgtccaaccgtctgaacgcgacctacgaggtcaccaagaagcagtgggacaacggatacctctcggctctcgtcgacgagaacatggccgtcaccggccaggttgtcgagcagctctccgagcatcagtgcgaaggcttcctcgaggcctacctgctcaccggccgtcacggcatctggagctcctacgagtccttcgtgcacgtgatcgactccatgctgaaccagcatgcgaagtggctcgaggccaccgtccgcgagatcccgtggcgtaagccgatctcctcggtgaacctcctggtctcctcgcacgtgtggcgtcaggatcacaacggcttctcgcaccaggatccgggtgtgacctccgtcctgctgaacaagacgttcaacaacgaccacgtgacgaacatctacttcgcgaccgatgccaacatgctgctggccatcgccgagaagtgcttcaagtccaccaacaagatcaacgcaatcttcgccggcaagcagccggccgcgacgtggatcaccctcgacgaggcacgcgccgagctcgaggctggtgccgccgagtggaagtgggcttccaacgccaagagcaacgacgaggtccaggttgtcctcgccgccgccggcgacgtcccgacccaggagatcatggccgcttccgatgccctcaacaagatgggcatcaagttcaaggtcgtcaacgtcgtggacctcatcaagctgcagtcctcgaaggagaacgacgaggccatgtctgacgaggacttcgccgacctgttcaccgcggacaagccggtcctcttcgcctaccactcctatgcccaggacgttcgtggcctcatctacgaccgcccgaaccacgacaacttcaccgttgtcggatacaaggagcagggctccacgacgacgccgttcgacatggtgcgtgtcaacgacatggatcgctacgcccttcaggccaaggccctcgagctcatcgacgccgacaagtatgccgacaagatcaacgagctcaacgagttccgcaagaccgcgttccagttcgccgtcgacaatggctatgacattcctgagttcaccgattgggtgtacccggatgtcaaggtcgacgagacctccatgctctccgccaccgccgcgaccgccggcgacaacgagtgagcatagtctcatcgcttagccgatgaaaggcccgggtgtcagcacccgggccttttgctatccatttgctatccatcacacaacgccgaatatcccatacccatacagaatgtgacctgcgtcacattctcgtggcaattgcaaaataaccggtctgccacgcccccttcccagttacaatggtctgcgtgcacaacgcagtcgcacgtcaggcagatcatcgatttcaaaggagtcatcgtgagcctcaaaaacgtgagcatcatcagtcccgaacctggagacggccggaacgtggtggcattgggtgtggtggatatgctcgcccacaccgcgaagaccagcatattccgaccggcggtgcaggcagacgaaaatctcaccgatgcactcctctcggtggtgagcgtgctgcagacgcgcgaacaggccgtcggcgtcacactgcatgacgcacgtcttgacaaagacaatgcccgccagcagatcgtctccaaattcatcgacacgaatgccgagatcaatccgcagatccgagtgatcgtcggatcagaccgcaccaatgtgggcgatcccgaacggttcaccttcaatgcggacgtctccgccgacctgcagtctccggtgctgctctcagtgagctcgatgggacgcacgccggacgagattcgtgagacgatagacgcatgccgcgaggtggtcgccaacgcaggcacccaagtgatcggcgtgttcatcaccgactgcacgaattcggcgctgcccacactcaccgacgaattcgtgagctacgacctgccgacgtggccgcttcccctcgtggaactcggttccgctgacacgaatgtcaaggccgcgctcgatgccttcgacgagcatgtcgacaaggaatcactcctcaacgtgcttgacacacctttcgtaccgccgaccacaccattcgcgttccagtacgatctgctcgcacgtgcgaagaaagacaagaagacgattgtgctaccggaaggagaggacgaccgcatcatcaccgccgcgaactacctgctgcagtcgaatgtggtcgatctggtcatcatcggcgaccgcaacgagattcttgcccggggtgaaaaactcggcctcaaggcgcttgatcaggcgaagttcgtctccatcgacgacaagcatctgctcgacaccatggtgcccaaactgtgcgaattgcgcgccaagaagggcatgacccccgatgtggctctgaagacactcagggacacgaactacttcggcaccatgctcatcgtgctcggcatggccgatggtctggtctcaggtgccatcagctccaccgccaacaccgtgcgccccgcgctccagctcatcaagacgaaacccggtgtctcctccgtatcgggtgccttcctcatgtgtctcaaggaccatgtgtcggtatttgccgattgtgccatcaacctcgatcccgatccgcagcagctggccgacatcgccatccagtcggccgagaccgccaaggcattctccatcgatcccaaaatcggtttgctctcctactccaccttgggttccggtaagggaccggatgtcgatctggtagtcgaggccacttcgatcgcccagaacaaacgaccggacctacccatcgtcggtcccatccagttcgatgccgcttggtcgaagacggttgccagggtcaaggccttcggcaacccgattgccggcaatgtcaccgtgttcgtgttcccggacctcgatgcggggaacatctgctacaaggcagtgcagcgcacctccggcgccgtggcgatcggaccggtgcttcaggggctcaaccggcctgtcaacgacctgagccgaggcgccttggtgcaggacatcatcaataccatcgccttgaccgccatcgaagcgcaaagtaacgaatagtccacaccatctcgcgaattcatgacgtggatgggtgctttttcgaaatatagaacgagagggcacccattcaccgttttgtagcaaacattgagtaatcttgtgtgttggaaagccgcatagcggcagagcaatcaccaatggaggatgccacaatggcgaaaaccgtccttgttatcaattcgggttctagctcgatcaagtaccagctggtagatctcgagtccggcgaaggaatcgcatcgggtatcgtcgagaagatcggcgaaccgattgacggccactacaagtacgaatacaacggcgaaaagcacgagctcgacgagaaggtcgaaaaccatgagcagggcctcaagcgcgtgctcgggttcttcgaggaatacggcccgagccttgaagagaccggcatcatcgccgtcgggcaccgagttgtccagggcggcgacaccttcccgaaccctgccttggtgacccccgacaccactgccaaggtcgaggagctggctgtgctcgctccgctgcacaacggcccggaggccaagggggcgcgagtcatgcgcgagctgctccctgagattccgcaggtttatgtcttcgactcctccttcttccagcagctgccgaaggcatcgagcacctatgcgttgaacaaggaagtcgccgacaagtacaagatcaagcgttacggcgcacacggcacctcgcactggttcgtctcctcccagattccagagttcctcggcattgacgccgaggccgccaagggcctcaagcagatcgtgctgcacatcggcaacggcgcctccgcctccgcggaactcggcggccgccccatcgagacctccatgggcctcaccccgctcgaaggcctcgtcatgggctcccgaacgggcgacatcgatccagccgccgtgttccacctgatgcgcaatgccgatatgaatgtcgatgagctcgacgacctgttcaacaagaagtccggcatgatgggcatgaccggcttcggcgacatgcgcgaagtgcaccgcctcgttgcggaaggcgacgagaacgccaagctcgccctcgacatctacgtgcaccgcatcgtcagctacatcggcgcctacaccgcacagctcggcggcctcgatgtgctcaccttcaccgccggtgtcggcgagaacgacgaaatcgttcgccgcatggtgtgtgagaagctggcaccgttcggtgtcaagctcgacaacgacaagaacgacacccgttcgaaggaaccgcgcattatctccacgccggattccactgtcaccgtcgtcgtctaccccaccaatgaggagctcgccatcgcacagcgcgccaacgagatcgtcaccgccggggaagacacctacggcaacaagatctgattctccacaaaaaatgtgaggggctgcaagaccgttcgtcttgcagcccctcacatttttccgggcgcctactgtcacttgccgcgcaacatgccattccacatacccacgaaatccggaatcgtcttgcgcgtggtctccacattcgttacttcaatgccatcaatcgccaatccgagcatcgcggcgaaggtggccatacggtggtcggcataggtctccatcactgcaccgtgcatcaggtcccgtgcaaccggtgctatggagaggccctccgcctcctcctgagcgtcggatcccacacgattgatctcggtagccaacgcctccagacgattcgtctcatgacctctcaggtgaccgatgcccaccagcacactcggtgcgttcgcgaatacggctatggcggcaatactcggcgttatttcaccgattgccgaaaggtcgcactcccccaaaccttcgattacaccatcgctgctcacttccaaaatgccgttgtaatcatcggggaagcattcgcaatcgttcacctcattgaacggttcaccccccaaagtgatggaggcaccgaaccgatgcagaatgtgcggcaggaaaccacctggctgcgtggtgtgtgccggccagttcggaatacgcaccgagccggatgcgatcaatgccgcacccaggaatggtgctgcattcgataggtccggctccaccaccacatgagccgccatctgcaattcggcatggtccacaatccatctgccccgttgtggcatttcgatatggcctccggctgcatccacgtcttccatcgtcatacgaatatggggcatgcttggcaattgcacaccggtatgctcaagaatcaagccatcaggcagccgcgatccaatgagcaggagtcccgaaatgaactgagaggaagccgatgaatcgatacgcaccttctgtggcttgcctttgagattgcccagttgcacaggcggcgtcaccgtaaatggtagatgcccctcctcaccttcgaactctatgcgagcgcccagctgccgcataccctcaagcaccgggcccatggggcgtgcgtaggcctgctcgtcaccatcgaaacgcaccggtcccttggcgaataatgtcaacggcggcacgaatcgcatcacggtgcccgcaaggccgcaaaacacctcggtattgccagtgaacccttcggcggggggtatcaccgtaacagtggtgggttccgtcgcgtcttcctggaaggccacgcccaaggccttcaatgcccccatcatcagttcagtgtcacgcgatcggagcagaccctcgatgcgcactggcttgcgagatagtgccgccagaatgaggaatcggttcgacagcgacttggatccgggaatggtcaccgtggcgtcgataggcgcggtcgccacaggtgccttccatatggttgtgttctgttcactcatactcatatcgtatcgttaccagtgaaataccgtgtgaaaatgctcctaagagggggacatatggaaaactcacggcgactgcaggagttctaggtcgggctgacaggatttgaacctgcgacattctgctcccaaagcagacgcgctaccaagctgcgccacagcccgaatgtgccttctcggggcgtagaagcccgtcaagcacaggaaataactataacacagggtctgacattgtgcatacaatggggtgtcggaagatcgaggtgatatgggacgtcatcaacgggcagaggcctcgggcctcatctcattcgtgatttgcgccatcataggcggattcggcatgtattggtacatgcaggcagcttcagccttctggcagatctcacagcgccggttcatggtctgcgccggaatcgtggcggcatgcggtgtggcctcgttcatcgccggatacctgcggcgcaggagttacaacacgttccgtggcatttggatgttccatctgcgccgcatattcgaggtgctcgccctttccatcgtctacgcctccacgctcttcctcacctcgtacatgctgttcaacgtgatgaacggtgccatgggcaaaaccgtattcagcacctatattccggccatatgtgcggctttcgccggggtatccggttacctcacctttgtgcaggcggaattgatggatgccaagacactggcgtcactgctgcccttcttcattatttcaggcgtctgcactgcaagtttcaccaccaacgacccctattggttcaataacaatttctcgcaactgggtgaccgtaccacttttgctgcccgtatgttcaactcgacgctcattctgggcggtatctgcatcatcatcatcagttacttcgcggtttccgagctcatcgccacctaccgagtgaggggtcctcatggcaccgtgcacatgcgcaatccgcatttctcataccatgtgccgaagttcagggcgcgcatcatcgccttgtccatactgctggtgctgtgtggcgtgtgcttcatcggcatcggctgcttccgctatacccctcatccgattctgcataatgtgttcgcccgtggcatgccgtgcgtgatgttcgtcatgctcataggactgccttggctggcgccgcagctgtcgagatcgttcttcgtcatttccgatctcgccttggtggtctgcgccgtggagggtgtcatgtggctcaaaggtcacaatacgctgacgaatgtggaggcgctggccgccatgctgttccttggctggttcatcgtcttctcccggcagatcgcctccattgaggccgaccgcatccagcagcagttgctgctcaggcagaccgtctcgctcgatgagctcgatgcgaatgaggttttggatgacgccgcggagacggaattccagaccgtgcttgacgaggatcccggcattgtgggcaacgattcgaagggtgtaccggcccaacggtcataatgaccttatatcgacgcgtgttgcgtatgcgaatggtttttcgctcgcatacgcaacatatctcaacgctggttatgatccgctttacggtcgctcatgagcatgaggaacgatcttgactgggccgtgatggcgaatcccgcctcgtaattgagctcgggtccctttggattgtgtgtgtcgacgatgagccgccatttgcgcccatactgctcgcttggcaacgtgaacatgatcggctcgtaatgggcattgaaaatcagaatgaaatcattgtccaccatgcggttgccgtaccaatccgtctccggcattccgccgccgttgaggaacaccatgatggacgaggcatgcgtattcgaccaagcctcggcatccattatcttgccattatgctcgaaccattccacctgaggcactgcatcctgcggcatatcgctgctgcgcccggtgaagaagcgccggcgatgcagcacaggatgctcgagtcgtatatggatgagcttcgtgacgaagtccagcatgtcctgctggtagtctttgaggtcccaatgggtccaagacaattcgttgtcctggcagtacgcattgttgttgcccaactgcgtgcggcacacctcgtcgccgccgcagatcatgggtatgccttgcgaaagcagcaacgtggcgaacatgttgcgcatctggcgatgcctcaattcgttcacgtcgcgaatggtggtgggtccttccacaccacagttccaggaacggttgttgttctcgccgtcacgattgccctcatcgttggcttcgttgtgcttctcgttatagctgacgagatcgttcatggtgaaaccatcgtgcgccgtgacgaagttgatcgaggcgacgggctttcggccgttcttctgataaagatcggaggaacccatgagacgactggcgagctcgggcagcgtggatggctgcgagcgccagaaatcgcgcacacagtcacggaaatgaccgttccattccgaccaattcggggggaatccacccacctgatatccaccggaacccagatcccatggttccgcgatgagtttgacccgtgagatcaccggatcctgctgtacgatgtcgaagaatgcggagagcttgtcgacctcctggaactggcgtgcgagggtcgcagccaaatcgaagcggaagccgtcgacatgcatctcctccacccagtagcgcaaggaatcggtgatgacctgcaaagcgtgaggcgagcgcatcagcagcgagttgccagtgccggtggtgtcgaagtagtgcaacgggtcgttgtcgaccaaacggtaatacgcctgattgtcaatgcccttgaagctgagcgttggccccatgtggttgccctccgcagtgtggttgtacaccacatcgaggattacctcgatgccgttgcggtgaaactccttgaccatggcgcggaattcgttcacctgttcgccgcgctggccttggcttgcgtaggcattatgcggcgcgaagaatcctatggtgttgtatccccagtagttgttcaggcctttctcctgaaggaacgggtcattgacgaactggtgtatcggcatgagctctatcgcgttcaccctgagttttttcaggtattcgatgacgtttgggtgtgcgaggcctgcataggtgcctcggatctccggaggcacctgtttgttcagattggtcatgccacgcacatgggcttcgtagatcacgcaatccgaatatgggatgtacgggtgctggtcactgccccaatcgaagaacgggttgatcacggcggccttcatcatatgcgccgcggaatcgagatcgttcatgttgtcggggttgttcgggtcgttgaaccaatatgagaacagactttcgtcaccgtcgatgttgccttctatggccttcgcgtacgggtcgagcaacagcttgttcgggttgcaccactgcccctgctccggattgtacggcccgtggatgcgatagccatagcgttgccctggctggattccgggcagatacgtatgccagacatacgaattctgttcggtgagttcgatgcggctttcgttgtcctgatcatcgaacaggcagagttccacccgttcggccacttgggagaagagcgcgaagttgacgccggcgccatcgtagctggctcctaacggatacattgaacctggtcgtgcttgcatgtatcccagtatggcacattccacggtggcacgtgcgattttgcttctcggctatttaacctgcaattcacgtaatcggcgtatccgttcatgctgaatcgcgatgatcgagttcgatgcggtaaccggcaacgtgagcagatcgtcccaaccgacccacgtcgactcaacatgctcgtcaccatcgaactcggtgtgtgtggcatgccaggcatgcagatggagcacgaagatatgcgcaagctcatcggtcatgccctccgaggagtagtaatcgccgacgatatcgaaatgcacgtcaccgtcggtgtccgcaaccacacccgtctcctcgcgtagctcacgcaacgcggcggtatgcgggtcctcgtcatggtcgatcagcccagcggggagcccgtaggtgaaccgtccaatccccgcacggtactctcgttcaatcaggtaggtgtcgcgcacgcaatcatgcacgagcatgaccacacagggcgcatgcaccagcacctgccggcggatgacaatctggtcgccgttgttccgcgtcaatgcgattctacgatcatcgacatggaatatagcacccctgtacttggtctcactgtccagtactcgcgcggggatgtccatgttcacgccatctgaactgcggtcgagcatggcatcgatgatctcagattccacattccgctcactgtcgcagcccatgggtcacctaccggcttctggcgatggatcgggatggccgcagacgcccggaaggaccagatcccatgggtcggtgctcgtcgtgttccaacgcacgtcgataatgtctcccgtaacttcctgcaccatccgcggaacgtcttcgagcgcatagttgaaccacatgctctctatggcgctgtgcggggtgttgatgagtgcggggcgcatgtgggggcaatcggacggccctcccaatccgatcccctccctgcgcatggaggcttcgtagtacgattcctgaagctcatcggtggcagggtggtggcgtaggtcgctggtcacatacacatcggcgtgcaatgcatgcacattcgcgaacatggaatcgccggaaccaggaagcaccgccaccgtgcgaatcggcatgtcgagcggaccagccacctgtatgccgtatttcgtgaatggcaacacctgagccacaagggtggcgaaacgctccaatgtcgtcggcgtaccgagcctgccgaaacggccaatgcccaccgtatgggaggaagtcggatcgtcaatcggcactatcggcgcctgattctcaagcccgaacgcatcagcggctgcttgcgcaacgccacggtaggcggcatcggcattcgtgtgtcctacccacagcgcgcagtcgtgcttggcaagcaggttgactatgcgcccgcggaatgtgcggcctgaaacctcgtgcacggcgcggaagaacagcgggtggtgcgtcaccagcatgtcggctccactcgcgatggcgtcttcgaccacttccatggtcggatcagccgcgaacacgatgttgttcaccgtattgcgcagatcacccacaatgagtccaggatggtcccaatcctccgcatatcgcaatgggtacagcgtttccagcgcacccatcacatcgtataccgtggccatattcactccttatcccacgccgcccagaacttgctcagtgggcggcctgctgccaatcggaccccacaccggtggacacatcaagcggcacggcgatgttgaccgcatgctccatcgcatcacgcaccaactcggtcacacgcttctcctcgccgggagccagttccaccacgagttcatcgtggatctgcagcacgatgcggctgttcaggttgccgtcccgcaaagcgcgatccacgcggatcatcgcgatcttcatgatgtctgcggcagtgccctgaatcggggcgttcagtgcaccccgttccgcggcatctcgtgccacccggttggccgatgtcaaggcggggaaataacgccgtcgaccaaacatcgtttgcgtatagccggtattgcgggcattggataccagcgactccagataatcatgcactttgccgaaggtctggaaataccgcgatcgcagtgcagccgcctccttcgacgggatgcccagctgctgcgagagcccataggtgctcaacccgtaggccagcccatagctcattgccttcacgtggttgcgttggtcgggcgtcacctcgtcgaccgggatgccgtacaccatactggccacataccggtggaagtccgcccctgacttgaatgccttgatgagcgcctcgtcgcccgacagatccgccatgatgcgcagctccacctgcgaatagtcggcgctgagcaggtctgcgaacccctcaccaggtacgaaggctgagcggatgtcacggccggtggcattgcggttcggaatgttctgcagattcggatccacggaactcagacgtcccgttgcggcgaccgtctgcgtgaacgtcgtatgaatacgcccatcgcgcggattgatggcgtcgatgagcgtctgcacgatctgacgcagcttgttcacctcacgatgccgcagcaatgctccgaggaactcgttggggcggctcccctcctcggaggtcgcgtacaaggtggtgagcgccttggcattggttgagtatgagcctcttttcgtcttcttggtgggattgagccccatctcttcgaacagcaccacaccgagttgcttgggactttgcagattcacctcatggccggcagcctcataacagatctgttccatgcggttggattcgtcggtgaacatctccagcaattcatcgagacgggcacggtccacgctggctccggtgtgctccatatggaacaacgccaccgaggtgggcaattcgatatcacgcaacaggctgtactggcagcgttgttcaagctgccgagccaacgttcgggccagcaggctcacaatggcagcattacgcaccacctttcggtcacgttcggcgcgttcgtcatccattccgatatcgagggtgccctgttccgtctccgtcacctcctcggcgtgccgatgcaggaagtgatcggcacaatcctgcagcgatcccccttggaaatccgggtctatgagatatccggcaagattggtgtcgaacagcaccatcggcaatcgcagattcacggcaccaagcatgtgcagatgctccttgtacccatggacgctcagtgtggcggcataggtgtcaagaatacgctgcagagccatatggtactgctcgtcatgcgggtcgaccaccaccgcatgaccgtcggccatcaacgccagtcccgagatcgaggatcgtcccggcttggggcttcccgatgcgaacagactccaggaaccttccacggcttcgacgcattgctggctttgcgcgtcatattcgcccaccacatccaatgtggttgacgagatgctcttgcccgaggcgatgggacagtgttgctgggcccatgcctcaagcgacgcgggggcgtcgatttcatccaccacaggttcctgcaccctcactgattcgggggtgtcgaacgacccatcgtcaaactccccttcgaactcgaaccgttcagcgtcagaggcctttttcgcgaccggctggcccgggtcccccgcattgaatgttttgaggagtttgcttcgaatgcgtgcgccgaagttgagctggttgaacagctcctccgccttggcgggatccactttgccgaaggtgaggtcggcgatgtcaacacctagatccagatcacgcaccaaggcgttcaccttgcgattgagcctgatctgttcaatgctctcacgcagtgcgtcgcctttcttgcccttgatctcgtcggcatgctcgatcacaccgtccaaaccaccgtattggttgatccacttggcggcgaaaccgtcacccacacccggcacacccggtatgttatcggcggtctcaccgcgcaatgcggccagatcggggtattggcgcggggtgacatggtatttgtcctccacggcctgcggggtcatggccttgagttccttgaaatgatagcccgggtacagcaccgtgatgtcgtcatcgatgagctggaatgcatcacgatctccggacagcacataggtgcggtaatccgcatgctcccccatcgtggccagtgtggcgatcacatcgtcgccctcgtatccctgcttggtcacataggtcacaccgaacgcctcaagcatgtcctggatgagcggaatctgcgagatgagttcttcgggggctgcttcacgtgtgcctttgtactgggtgagcatcttgttgcggaaggtgccccccttcacgtcgaaggccacgccgagcagatcgggcttctgcgatgcgatgacctgcgaaagcatcgtgaagaagccgtagaccgcattggtggcctgaccgtctttggccgagaaattctccgctggcagtgcgtagaacgcacggaatgccagcgaatggccatcaatcaccagcaacgttcccctggtgccctgttcattcgtttccattacccacccgttccgttgatttgtcaccatatgaaaacgtgacgtgcaatgccttgcacgtcacgttgagcgccataggtcactccccatcgttcggcttgtcgctgtatttctcgatgatggcctgtgcaaggcgtttcttcggaatgcgctggtccatcgaggtcttctggatccaacggaacgccccggattccgagaagttcgctttatccatgagcaaccccttggcacggtctatgagcttacgttcctcgagcgtctccttggtcttgcgcagttcctcctcggcgtccctcaactgctcctgggtggtgcgcaattcgctttcgttgcgttccacgctgtcaagcagatcgttgatctcggcgaaacggcccatggccaccgccaaggcaggcagcagcttggattcctcatagggcttggtcacataggccatggctccggcaccaatggcctccttcaccagatcggcctgagagaatgccgtgagcatgaccacaggggccagattctcatcgcagatcacgcccgccgcggtgattccatccatatgcggcatcttgacatccatgcacacgacatctggcctcttctcgcgcgtgagttcgatggcctcctcaccattggcagcctcacccaccacctcatatccgttgtcttcgagcatggccaccagatccatgcggttcaccgactcgtcttcggccacgaccacggtgggattgcgcttggcctccttcttggcgacctgtgcgtcagccacctcgatcgcatcggcggcgttgtcaaccgttggttcctcggtgatgctctcttgctcttcgttggacatacaagctctccattcattatttcatgcccgcgctccatatacgcatacacatgcgggctatgacatattcctgtcggacgtattcagtgctccaacagcacagtgtagcgcacttatgcgctaacatgcgtgtcagtctcgtgccggagccccatcgtacggggaaacaccgatcatatggttcggcgccatgtacaggcgctggatggcgatgatggacttggcatcgagaatcgtgccgttgagcaccagctcatagcactcctgcggggtgaggaagcgaacctgggcacgtgcctcgttggcgtactgttcccgttcgtcgatcggttcgagatcatatgcgaagtagagggcggtgtgctgcgtggagtagctcggcgtattgatgaagcggcagaactgcgtcatcacccccgccttgtacccgacttcctccgcaagcttgcgatgcgccacgtcgatcggcctttcgcccttgtcgaccgcatgccctgcgggaatctccaatgtccaacggtgcactggtatgcggtactgttcgatgagcgggaccctgccgtctttcgtcagtcctatcacgccaactgaatcgccgttgttcttgtgcaggatgagacgttcgaaatgccccaccgtcggggaggttaacgatacgcggtcgatgttgaagtagtggccgccgactatggtttcgcgcgcctcctcttggatgggggtactgcgccatggatcgaagcgacgataggtttgcttgctcatgccagtcctttctggttgtctgcggctcatctgtctgtttcccattgtatacagcacgaaccgcgatgttccgttaacagcggataacatgcgatgaaaaaggctcgccatgaatgttcacggcgagcctgtcggtgcccccggtgggactcgaacccacactgtacagattttgaggctgtctcctctaccaattgggatacaggggcgaaagcaacctatgtgaatatagcacatacctcggcttttgccaattcagacactccgagatgacaacatggggtgtgcatccgcggatgcacaccccatgagcgtcctgcccgtcatgcgcttaggacgctgacgggtatatgcgatcagtcgcaggcacccacggtgtgaacgtagatcgaatcggtgcggccgggcagatgctcaccctgggcggagctcagcacaacgatcttgtcgccattggcgaccttgccgttcttgcgcagcacctcgtcggtgaaggtcatcagatccttgcgggacatgtcgtggtaatcctcatcgagcttgatgccctcggtgccccagctcagcgcgagccagtggtaggtgtgctcgttggtcgtcaggccgtagatcggggtggccgggcgctcacgggagacgcggtgcacggtggaaccggtctgcgtgtaggcgacgatggccttggcattgagcttctctgccagatcagcggctgcggacgacactgcgccggtgctcgacatgtcgagatccttgaggtgagggatgcgatcgaagccgtgctcggtggcatagccggagatgcgggccatcgtcttgacggtctcgaccggatactcgccgacggcggtctcgttggaggtcatcgtcgcatcggcgccgtcaagcacggcattggcgcaatcggaggcctctgcacgcgacggaaccggcgaatgcaccatggagccgagaacctcggtcgccacgatgaccggcttggcgtactggcgggacagctcgatgcagcgcttggtgaccagcggcacctcttcgaacggcatttccacagccatgtcaccacgggcgaccatgatgccgtcgaacactttgacgatatcctcgaggttctccacggcctgcggcttttcgatcttggccacgatcgggatgcggcgcccttcttcgtccatgatctcatgggcgcggtcgatgtcggtcgcgaaacgcacgaacgacatggcgatgatgtcagcgccggtctggatggcccaacgcaggtcgttctcatccttctcggtcagcgcaggcagcgacaccgcgacacccgggaggttgatgcccttgtggctcgagaccgggccggcgacaacgaccttggtgtgcacgttgtttccttcgaccttggtcacctcgagacggaccttgccatcgtcgatgaggatcgggtcccccggatggcaatcgcccggcaggcccttgaacgtcgtggaggtgatgtgttcatcgccttcgacgtcatcggtcgtgatgatgaactcctggccttccttgagctgcaccttgtcttcgccttcggcgttcttcttgaaccagccgcagcggatcttgggaccctgcagatcgacgaggaccgccacgttgcggccggtggtcttggatgcttcgcgcacgttgttgtacacgcgcagatggtcttccggagtgccgtgcgagcggttgagacgggccacgtccatccccgcttcgacgagcgcggtgaggttttcgagagattcagtagctggaccgatggtatctacgatctttgctttacgcatgaatgcctacctattctttgacggttgtgctccttggagagcacattcaacattgctctagcttactcctttttcgctttagcctgtcgcaaatagcgaagaagtctgtgagcgctcacaaccattgtgccgcaagtacacaccatatggctctccggcatgtcgcctcaggggcgctcctgcgaatccgaaggtgccgcggcctgcttcgcgtcgatcgacttcatcttgatgacactggctaatgccgaaccgccaatgcagacgatgatgacaaccagcgaaagccacgtgggcacttccggcaccatgcccaacggttggccatggttgatgaacggaagcgtgttgccgtgcaacgcctcgagaatgagtttgacaccaatgaacccgaggacaagcgacaggccgaccggcagatacacgagcttgtcgagcaggcggcccagcaggaagtacagctgctgaaggccgagcaatgcgaacacattggaggtgaacacgatgaacggatccttggtgagaccgaatatcgccggaatcgagtcgaaagcgaacatgacgtcggtggtgccgatcgtgatgaacacgatgagcatgggggtccaatacttcctgccgtcgatggtggtgcgcagcctctcgccgtcgtattcattcgtgatatgggagaatcgccgcatgaggcgaatcagtccgttctcatggaactcctcatcgtcgtcctcccctatcgccactttgacggccgtatagatgaggaaggcgccgaaaatgaagaacacccaggtgaaacgcgagaccagagcggcaccgatgagaataaacagcccgcgaagcaccaatgcaatcgttatgccaaccgagagaacgaacttctgcagtttcttcggcaccgcgaagttcgacatgatgatgacgaacacgaagaggttgtcgatgctgagtgaatactcggtgagccagcccgaatagaactcaacggccggcttggccccggccacccaccatatcaatccgccgaagacgagcgccatggcgacgaagaacgcaatgtgctgcacgcattccttggtcgacggtacatgaggcctgcgccccaggacgaagagatccacgacgaagaagacgaccagcacgacataggtgccgatcatgaacgagataggtgtttctgccatacaggccagcttaacgcaagccgtccgaaatgggctgtctactgctgcgcctgtgtcatggcccgcagctccttcttgaggtcgcgaatctcgtcacgcaagcgcgccgccagttcgaattgcagctgttcggccgcggtatgcatctgatcggaaagctggcgaataaggtctgcgagatcctgtgcgggaaggccggccttgagaatctcctcatggcgcctgtcggcttcctcgggcgtcgtgttcggcaatccaagatgcgagttacctgccttgccggagttgcggtagccgccctcgagcagttcctgcgtgtccacgtcctccttggcgagcatgtcgttgacgtcgctgatcttcttgatgagcggcttggggtcgatgtgatgctcctcgttgtatgccatctggatctcacgacgacgattggtctcctcgatcgccttgctcatcgaatccgtcatctcatcggcatacatgatcaccgtaccgctcacattgcgtgcagcacgtccaatggtctggatgagcgatcggtacgagcgcaggaagccttccttgtcggcgtcgaggatcgccacgagcgacacctccggcagatccaggccttcacgcagcagattgatgcccacgatgacgtcgatcttgccctcacgcagttcgcgcagcagttcaacgcgtcgcagcgtgtcgacgtcggagtgtaggtattccaccttgatgccgcgttccagcaggtaatcggtgagatcctcggccatcttcttcgtcatcgtcgtgacgagcgtgcgctcccccgcggccacacgatctttgatttcggcgagcagatcgtcgatctgtccctccaccgggcgcacttcgatcttgggatcgagcaagcctgtgggtcgtatgatctgttcgaccacgccatccgaaagccccagctcgtaatctcccggtgttgccgacagatagacggtctggcccacccgatcgaggaattccggccatttgagcggacggttgtccattgccgagggaagtcggaacccatgctccaccagcgtgcgtttgcggctggcgtcgccctcgtacatagcgccgatctgggggacggtcacgtgtgattcgtcgatgaccagcaggaaatcgtcggggaagaagtcgagcaatgtgtgcggtggcgtgccggccgcacgcccatcgaagtgacgtgaatagttctccacacctgagcacacccccacttgcgagagcatctccagatcgtacgtcgtacgcatgctcagacgttgcgcctcaagctccttgccctgcttgcgcagctcggccacacgctcgtcgagttcccgctggatcgaatccaacgccttcgccatgcgttcgggaccggcaacgtagtgcgaagccgggaagatgtgcacgtcactgacctgctcgatcacgtcgccggtgagcgggtgcagtgtggagatgcggtcgatctcgtcgccgaagaactcgatgcgtatggccagctcctcatacaccgggatgatctccaccgtgtcgccccgcacgcggaaggtgccgcgcgtgaatgcgatgtcgttgcgcttgtactgcatgtcgacgaaggtgcgcagcagatcgtcgcgatcaatctggtctccctcgtgtagaaagagcatgcgaccggcgtattcctcaggcgtgcccaaaccgtatatgcaggagacggtggccacaaccacgcagtcgcgacgtgtgagcagattcgcggtcgcggcatggcgcaggcgctccacgtcgtcgttgatgttcgaatccttctcgatgtatgtgtcggtctgcgggatgtaggcctcgggctggtagtagtcatagtacgagacgaagtagctcaccgcgttgtccggcatcagctcgcggaattcggcgcacagttgggcggcgagcgtcttgttcggttcgatgatgagcgtgggccgctgcagccgttcgatgagccacgcggtggtggcggtcttgccggtgccggtggcgcccatcaatactacgtcgttctcgccgttctcgatgcgagtggccagttcctctatggccttcggctggtctccggagggctggtacggcgacttgacaacaaacggcttgttcgtgcgctcgatgttgaatcccatggcgatccttactcctcggcgaaccattgtccgacaaggctatcaacatattcgaacgtctgttctatcggctgtgtcgcgtcgatgacaacgtcggcataccgcagccgggaggcctcgtctccctgtacatacacgcggatgtgcgcctgctcctcggtcatgccccgcgtctcgacaagcctgcggacacgcagatcctccggtgccatgacgcacgctatggcgtcgaacacgaatggaatcgtgtccatgacctcgccgagtaacgggatatcgtggacgatgacatgcttgcggccgtcgccgaccaaacttcgctccctattgcgagcgagctcgtacaccagtggatgcatgatgccgttgagtgtttcggtggcgttatccggggccccttctccgaacacatgccgggacaggatccgtcggtcgacgcctccgcgcccgttcagaatgccagggccgaatgccttgaccagaggatcgatcgccggggaacatggctcctgcaggatgtgcgcaagatggtcatagtcgatcacatcggcgccgtcttcggccattctggtggccacagtgcttttgcccgctgctatgccaccggtcagcgcgatgcgcatgcatcgccacccgttgacggtctgcatgatgcctccttttcacatgcatgggatatgtaccgggcatatacggagggaggcgccatgcgcgtgtgcacatgacgcctcccgaatcgaagcggaacagcttcagcggctcacttcttctcgctcagcagctgctcgcgaagagcggccagctggtcggaatcggcgagggtgccgttggattcggactcggaggagtagttcgaagtctcttcgaccttctcttccttggcaggagcctgaccgtcctcctgagcggaggcctcggcgttctcgagctccttgcgcacgaattccttgtgcagctcccacagaccgtgagcagaggcgtactgggcctcccattcctcacgctgcttctcgtagcccggaatccactcgttggtgttcgggtcgaagccctccgggtacttgtagttgccatcctcgtcgtactcggccggcatgccgtagagcgccggatcgaaatcctcggagttcgggtcgacagagtcgttggcctgcttgagcgacagggagatgcgacgacggtccagatcgacgtcgatcaccttgacgaagacctcttcgcccggcttgacaacggtctccggattttcgacgtgacggttggcgagctcggagatgtgcaccaggccctcgatgccgtcctcgacggagatgaacacaccgaactggacaatcttcgtgaccttgccacgcacgatctgacccggaacgtgggtgcgtgcgaagcgctgccacggatcctcctgagttgccttgagcgacagcgagatgcgctcgcggtccagatcgacgtcgagcacctcgacggtgaccttgtcgccgaccttgacgacctcggacgggtggtcaatgtgcttccaggagagctcggagacgtggatgaggccgtcgacgccgccaagatcgacgaatgcgccgaagttgacgatggacgagacgacgccttcgcgaatctggcccttcttgagctgcgagaggaaggtctcgcgaacctcggactgggtctcctcgaggtactgacgacgggacagaaccacattgttgcggttcttgtcgagctcgagcaccttggccttgatcttctggccgatgtacggcgagagatcgcgcacgcggcgcatctcgacaagggaggccggaaggaagccgcgcaggccgatgtcgacgatcaggccgcccttgacggcctcgatgacggtgccctcgacgacgccgtcgttttccttgatcttctcgatgtcgccccaggcgcgctcgtactgggcgcgcttcttggacaggatgagacgcccttccttgtcttccttcgtgacgacaagggcttcgatggtgtcgccgaccttgacgacatcatccggatcgacgtccttcttgatggaaagttcgcgggaaggaattacaccttcggtcttgtagccgatgtccaggagaacctcgtcgtgatcgaccttgacgacggtgccctctaccagatcaccatcgtcgaagttcttgatggtggaatcgactgccttgatgaagtcgtcaacggtgccgatgtcgttgatggcgaccttttcgacttctgctttgttttctgccattaatgtggtttcttcgaatagttgggtggataatatcgatattcagttattcaggcatatgctcgacggctggatacaccaagccccaaacacatgcagactcaattataggcgaagcactagccaaaacgcgcttttccgccggcgtgtcgcgttccccgagcgaatggctcacgaatcttcacgaataccggccatgcgctcagcctgttccacaacgttggcgagcagcatggcacgcgtcatgggccccacccctcccggattcggggaatacgcgccggcaacggcatgagcctcggaatcgacgtctccgactatgcgcattctgccggcctgttcatcgaatacccgcgatacaccgacatcgatgagcaccgcccccggcttgacgtgctccacctggacgaaccctgcgacaccaaccgcggcaatgacaacgtccgcgcggcgaatgtgctcctcgatgttgcgggtgcccgtgtgacagagcgtcaccgtggcattgacaccgctcctcgtgagcatcaggccaatggtgcgaccgatggttatgccgcgcccgagcacgcatacgttcctgcccgccagttctatgccgtaggcgtcgaggagggcgagcaccccgcggggggtgcagggcaacggcgtggtgatgtcacctcgaacatgaagcaccagttccccgagattgtaggggtgcataccatcggcgtccttggtcggatcgatggcgccgatgatggcgttcgaatcgatgtgggcaggcaaaggcagctggatgatgtaaccggtgcatgccggatcctcattgagatcgcgcacgacggcaagcacgtcttccgtcgtcgcggtcgccggaagctgcctgcgtatcgaggcgattcccacctcctcgcaatccctgtgcttgccctccacatacttcatggaacccggatcgtcaccgaccagcacagtgcccagaccaggcaccatacccatcctcgccaacccggccacacgcgaggcgaggtcggctttgatctggccggccaccttctttccgtctaatacgattgccatatgaatgtccctttcgcattcggtggagtctttcctcggccatgtcccgacctattattgcagaagaaacgaggaatcgacatcaagcacccatattaaggaacgtcatgcgtacactcggcaacggactccacgccatcgccgccatcttggctggcatcgcactgattctgggcaccagcgcctgcagctggttcggttcccggcagacgaacgagccaacgccaaacggctccactacccccgcctcgaaaatcaccgtcgtcgccacactgaaccaatgggggtcattggcgaagcagattggcggcaatcaggtggaagtctcgtcgatcctcccccccgacaccaccaacgcacattctttcgagccgaatgccaaacaggttacccagatgcgcaaggcccaagtgctgctgaccaacggcgcaggatacgacacttgggccgaccgttcacttccccggaacgtgacacgggtgtccgtggccgacacagtgggtgcattggatggcgacaacccacacctgtggttctcacgtgacgcccgacaggccgtggccagggaattgacagaggtgttcagcaggctcctccctgagcacaaggcatacttcgaaagcaatctgaaaacatggcagagcgacgaggacgagcttgaatcacagatgagggaacgcagcaagtcgctcaaagatcccacctatgccgccacggaagatgtcgcgtattatctgatgagcgacttgggattcagggacgtcacgccgaagggctatgccaaggccatgctcgacggcaccgagcccgacgagaaggatatcaaggcgttcagcgacttgctgcaaggcaggcaaaccaatctgctgattaacaacccacagcaaagtgcgcaaaccgacgccacgctcacccaggccgcgcacaaggcgagcatcccggtgatcgacatcaccgagcagatgcccaaggattgcaaagacctcacctcttggatcgacactctgagcgaatcgatcatctccaaagtctctcaggaacaggaacacgaggccgcatcatcaccctctccgagcgtcggcacacagcaggagactcctgccacgaagtaggcaataccatgcacctgtctccatcaatcagctgccctcttattgagaatgattgtcaatactgattggaacactgaattcgtcggatatgcgcacgccgttggcagtcgcatacgaatccaagaagaagaggtgagcgaatggccgatcggatgacaccgatgcagccctgcatcgtatgccacgacatcgcgatctcacgcggagggcgaacaatttggagcgaaggcaccttcaccattccacgcggcagcgcgaccgccatagtcggcacgaatggtgcgggcaaaaccacactgatgaaagcggagctcgggctcataccgctttcccacggcacgatgaccgtgctgggcaaaccggctggtgagatgaatgcgcacatcggttatgtaccacaaagctacgcctccgacatcgactcatcgctgaccgccgagcaatcggtgttgctcggtctgacaggcacccgtttcggcttccacatcatttcgaaaaaggagcgggacaaggcacgtgaggcgatggaattcgtaggcgtgctcgacaaggccccataccgtctctcccagctttcaggcggcctgcgccaacgcgtcgccatagcccaggccttggtgtcggacccagagctgctcatgctcgacgagccattggccaatctcgatctggccagccaacgctccaccgtgcacattctggccaagctcaacagggaactcggcatgaccatccaggtggtggcgcacgacctcaatatgctgctgccgattctcaccggcgccgtatacctgctcgacgggcacccccacttcgccaagctgaacgaggtgctcgactccaagttgctcacacacctctacggcacccaagtgcaggtggtcaccaccccgcagggagacatgttcgtcaccccgaacgcagacaacatcggatgcaacgatcacccagacatgcactcctcgtctgacgtcgcacaattccatcaccatgaggatgtgcgcatggacgacgaccacgcgcacatcgacaggaaaggcaatggacaatgagctcgttcttctcctatgacccgctatggacgcagacgcttacgatgcccttcatgcgcaatgccttcctcgcaggtctgtgcatcgcgctgagtgccggcatcatcggctacttcaccattgcgcgcaactccaccttcgcctcgcatgcgcttgcgcacatcgcattgcccggagcaaccggcgcggcgctgctgggcgttcccatcgccctcggtctgggcgtgtttgccgtggggggcgcatgggtgattgcggctttgggcaaacgggccggggaacgcgagatcgccacgggtaccgtgctcgcgttcgccaccggcctcggcctgtacttcgccagaatgtcaagctctgcatcccagcagctgcaggccattctgttcgggtcaatcctcacgatcacaccggaccagattatcggtttcgccattttcgacgccgtgctgatcatcctcatgtgcatcgtctatcggccgttgctgttcagctcgctcgatgagcaggtggcgcaggcgaaaggtgttcgggttggcatcatgaatgcactgttcatgaccatcctggccggggtgatcaccatcgcggtgccggcggtgggaacgctgctcatcttcgcgctcgtggtcacaccggcagccacgtccatgatcattaccgactcgccgttcaaagccattgtgatggccatggtgctgtgtctggtgagcatctggggtgggctggtgatctccacgatgttccccgcccctccgagtttcgtgatcgtcacgttgtccacactgttctggggcattgcgaagggcgtcgaaagtgtcaggaaccaccggaatggcgactgacgagattggggcgacgacccagattcggctgacgcattgagtgcgccgtgacaatcctcatagattgtcacggcgcactcgcacatatgcctctgatggacggggactgctcacgcagacgcgaccgttttcctcaccagtacgctggcgatggcggccaacccctcgcctctgccggtgaagcccatgccatcggtggtggtcgccgtgatgccgaccgggcaaccgcagatctgtgacatgcgttgctgtgcctcatcacggcggcaaccgatcttgggttgattgccgatgatgctgatcgacatgctcaccggctcgaacccatgggcatgcactaacctgagggtttcacggagcatcgcttcaccgcgcatcccggctcctcgggaatccgcacccacaccgaacagcgtgcctatatcgcccaatccggtggccgacgacaatgcatcgatgagggcatgcacggcgacatcgccatccgaatcaccctcgacaccattgccttcccactccaaacaggcaagaaaaaacggtctgggattgcgggcatcggcgaaccgatgcgcgtcgaatcccagaccattgcgcagatcagacgaatcgctcacttcttcttcgacttcttgctctcggactcgagacgggccagcgtgtcttgtgccggctcctcggggacctccgtgtgatgctcggcatcgccttcctgcggctcggcataaccgaggttcacatcgagcaggcgctgcgtctcctcctcgctgagttcctccgacagggcgatctctgaggtgagtatgctacgcgcctttgtgagcatgcgcttctcgcctgcggagagcccgtgctcatccacgtcgcgctgagaaaggtcgcgcaccacttcggcaatgttgttcacgtcgcccgtggcgatcttctccacgttgagcttgtaccggcgtgaccagttcatctccttctcgacgatcggcgtacgcagaatctcgaacacgcggctcacctcgtcgccgtccacgatgtcgcgcacacccaccttcttcaggttgtcgaccggcacgaagatctcaagatcatcggatgagagcaccgagagcttcaggtactcccgggtgacgcccttgacggtccgctgcaaaatctcttcgaccctagccgcaccgtgacgcggatatacgaccatatcgccgaccttgtatcccatgaatcctccgtaagagcaatgcaaaaacccgtataagtatgccctatcgcttggacttgcaagggttttgggcaaaaaagacgcttttttacgcagaatggctcccgaaccccgtgttgcatgcttatcctctatgtatgagtaacaatcatttcaataaagatgccatcgttgcagtggatcatgcccaactcggcaccgtgagcgagggtcgtttctacaaccctcacgagattctcggcgcccacctcggtagcggtgaatacagcgacaccgccaccgtccgcgtacttcgccctgacgccaaggaagtcgtcatcgtcacccccgacagcgagaccaaggccgaaccggaactcaacggcgtctatgtcgccgtggttcccgccgtgaaaaccgacagggggtattcggttcccgactaccgcctgcgcatcaccaaggaggacggctccacggtggtggagaacgacccgtatcgatacctgccgaccgtgggtgagatggatctctacctgttcggcgaaggacgccatgaacgcctatgggaggccatgggcgccaacgtcaagcgatatgaggactccatgggtggcaatgatggcacccatggcgaacctgtggtcggcactgcattcaccgtctgggcgccgaatgcacattcggtgcgagtggtgggcgatttcaacggatggaacggcatctgccattcgatgcgcgaactcggctcctccggcgtctgggaaatctttatcccgggtgtgacggccggcgagaaatacaaatatcagattctcaacgtattcaacacttgggagatgaaggccgacccaatggaacgctcgcacgaggtgccaccgaagacggcctcgattgtggtggagtccgaataccattggaacgattccgactggatggccaagcgcgcgaaaaccgacccgcaccagggtcccgtggcgatctacgaggtaaatgcgaacagttggcgtgacgacgtacacagctaccgcgagcttgccgacaagctcgtgccgtacgtcgcgaagctgggcttcacccacgtggaattcatgccgttggaggaatacccgtacctcggcagctggggctatcaggtgaccggctattatggcgtggactcccgcctgggctcccccgacgacttcaagtatctcgtcgacaagcttcacgaggcgggtatcggtgtaatcatggattgggtcccggcgcacttcccgaaggacgccttcgcattgggccgtttcgatggaacgccattgtatgaggacccggatccgacccgcggcgagcatccggattgggggacgtacatcttcaacttcggccgccgcgaggtgcgcaacttcctggtggccgacgcctgcttctggcttgatgagtaccatatggacggcctgcgcgtcgacgcggtctcctcgatgctctacctcgactacagccgtcaacccggtcaatggcatccgaacaagttcggaggacgcgagaacctcgaggccatcgacttcatcaaggaggccaacgccacggcctacaagaacaatccgggcatcatgatgatcgccgaggaatccactgcctacccgggcgtcaccgccccgaccgaccagggcggtctgggttatggactcaaatggaacatgggctggatgcacgatacgcttgaatacctgcacgagcagccgatcaaccgcaagtggcaccacaacgagatcacgttctccatggtctacgcctattcggagcattatgtgctgccgatcagccatgacgaggtggtgtacggcaaaggatcgctgttcggcaagatgccgggcgacgattggcagcgctacgccggcgtgcgttccctgttcgcctatcaatgggcacatccgggcaagaacctcaccttcatgggcaatgaactcgcacagtacggtgagtgggactacaacagccagcttgactgggactgcctgaactggcctgatcaccgtggcgtgcagcaactggtggccgacctcaacgctctgtacaagaagtctccagccctgtggagccaggacttcacccccgacggtttccagtggctcaccagtgacgattcggaccacaatacgttgagcttcgtgcgaatcggcaaaaacggcgagcagatggtcgtcgtggtcaacttctccggaacggcatggcaggactaccaggtggcgctcccacaaggcggccgttggcgggaggtactcaccactgacgacaggaagtacggcgggtccgacatccacaacaccaatatcgaagccaacgccggcccctaccattcgcgcgattattctacgaagataaccgtgccggccctcggtgtcgtattcttggaaccggataacaactgacacaagttgaaggaagggagcaatagcatgtctgctccttcgaatgacaacgaagtacgacgcaccatactcgtggtcgaggatgagcccacactggctacagccatcgcccagagactgaccaatgaaggctggacggcccgtgtcgccggagacggcgccacggcggtgaaagccgccgacaagttgcatccggatctcatcatcatggatctcatgctgcccgtcatggacggcatcgaggcaacgaaacgcatcgaggcacaacatcccattccggtgctcatgctcactgcgcgcgacgatgaggcagatgtggtgatcggactgggtgtcggggccgacgactatatgagcaaaccgttctcgatgcgtgagcttgtcgcacgtgtgcgcgcattgctgcgccgcgtggaccgggccaaggtgattgcgcacaagagcgagaatgattgcatccttgatttcggcacgttggtcatcgatccggccaagcgccaggtgacactcgatggcaaggaagtgcatctgactcccaccgagttcgatctgctgaccacgctcgccaaacagccgcattccgtgctcacacgcgagcagctgctcgaagaggtgtgggattgggttgacgcctccagcacccgcaccgtcgattcccatgtgaaagcgctgcgtcataaactcggcgcctccacgatccgcaccgtgcatggtgtggggtacgccttcgaaccgccagaagcgtaaggctcatgacggacgaggcatacaaccgccgaatgaggcgctcgcagcatcgtagggatgccaagcggcgcctcgttcgctactgttccacgctcaaggtggagatcacgatgctcattgtggtcgccaccgtgggagccttcctgctggcatgggtgttttcgaagaccaaaatcaacgattggctggcgctgcccgtcacgctcatcgtcattctggtgttcacctacgcgacgtcgcggcatctgaccgatcctttgggccagatgcgcgatgccgccgaacgtctctccgacggagactacacggcgcgtgttcccgacttctcgaataagtacgatgaagtgggacagcttgcccgcgccttcaacgacatggccgaggaactgcagcatgaggaccagttgcggcgcgacatgatcgcgaatgtggcgcacgagctgcgcacacccgtctccgcactgcaggcgatggtggagaatatggcagacggtgtggtggagccgaacgagaagaatatggagagcattctcgcccagacacaccgactcaccgacctgatctccttcctgcttgatttatcgcgcatcgaggccggttcctcgagcctcaacatcgaggagttcaacttcgcggatttcatcgacgagacaatcgcccccttgaagctccttgacagcagccgcgggcatgacatcgagacacacattccctcgaacatcgtgatggagggcgatgtggaccgcctacgtcagctgtacacgaacatcatcgccaacgcgctcaagcattccctcgacgacgccagtgtgctcgtcgaggcgcatgtggacgattcgcgcggtacggtggtgacaaacatcgtcaacttcggttcccagattccagaagatgtgcgccacaagatcttccagcgcttcgtcatgggcatcaccacacgcggtagtgaatccggcggcaccggactcggactgtcgattgcgaaatgggctgccacgttgcatggtggctccatccatgtggtggacgattcgaggggcgtcgatttcgagatcgtactgccgctgcatcccgacgtggagggtacagggcctcgcaagcagtaggttccgcaccccccttcgatggcttcccgctcacgaggcgagaagccatattcatatgagtatcaggcaaccatgtatccgtgtttcgatggcgtgtaggccagtgcgagtgcggtgaacaccgtatacccatgttcggcgagtacggtggcacatcgattgattgtcgcgccggtggtcacgatgtcatcgatcaggatcaccgtgcggcatgcatccatctccttgtcgtgggtggcacgttcattaatgcagatcgtccgtcgcgcacgctgcgcgcgttgatcggcaccgttggtctcgactgatttgctatgggcgcgtacgatgagcaatggtgccaccgttgtctgcataccccgtgcgttggcatgtgagcatagcgcctttgccagcggtgctagttggctgcggcctcgtctacgcaatgaggaggcggaggatggtgcgggaacgatcaatatgtcgttgggaacagctgcctgggggaattgctcgcccgattgtctgcagaatgcgagcagatcgtcgaacagccggttcaatgccgtgacgaacgccccatcgcattcctcatcgccgtggtccttccaattgagaatcgcctcgcgtgccacgccacggtagagtgcacaggcaaatcccaaatgcaacgtaccgggatgcagtcggaacggtatgcaatggtggaatttcgactcgcatcgactgcaaagcacttcatcgggagcatcacatcccgcacacccgcgtggaaacagcagataccccagttccctgagcaatcctgcggccgccgcacaccattcccgaacgaacgatgtacccataccgcactcctcgcgtctgcagactatcgtgaattcctgttataccagtcgatgatgcggttgcaaagctgcagggtgtcttccggaccggtgacccggatggcgattgttccagccaaagccgccggatagtcattaccatcggggtccatgcgatcacccacaaaggcaatctgtcccaccgtcacgccaagcatgtctgcgagcttgcgtacggcatacgccttgtcgacccctctgttcgaaatgtcgacgctggtggaacctcccgaacgcaccgcgagatggggaacatccttctgcacggcttcggcgagccggttcttcttctcattggtggggtcccattcctccttggcctccactggagcctgttgtccgagtgcggagaacgtgatctggctaccgcgatcttcgatgcgcggcccccatgtgcgcgcctgccatatgccgagttcacgggcgtgacgttccaacgattcgatgaccagcctgcggtcctcttcgctcaggttgtgttcgtacgcctcctgccaatcgtcgtcctcgggattccaacggtagtagcgtgcacctgatgtgggcatcaggtgcatatgtgaacggtcggcttcatcggaaagcatatcggtgacctgcgagcgcacgaggtcgatggtgccaccggagatgatggccacgggcagcaggcgcgtcagctgcgacaatgcatcagccatgggcttgtgcattggtttcttcgaacgggcgagtgtgccgtcgaggtcgaaagccatcaccttcatcgtggcacagagccgttcgatgtcgacctcgttcgccaaggccattgagactgattgtgacatgttcgccttactcctcgcgttctgttccactagagtaatataccaaagacggtgcgatgccctacagtggaaccatgattcgtgcaccatgggaagagaagacgtaccggaatcgtcacggcagaggggtccgcactcccccattcgggcgccgcctaccgcgctatcgcacacgcagtggcatgttcgacgacatggcgatcgcccagattcgccgtctcaacgatgcgtggccacaattgctagaaccgttgcagttcgctgtggaggacgttcctccctcctcccccgccccttgggagacgaatccgaggctcaattcccaagcgtttcccgcttcgcatggcataccggcccgtgtagtgctctaccgcatgccattgcagagtcatgcgcgatcgcggatggaccttcagctcgccattcgagatgaactggtgctgcgtatagctgagctctatggccgcagaccagaggagattgacccgcaatggggcatgtgagagaacctagcgcatgatggtggcatcatgcatggcgcgcaccgtctgtttggccacttcgagccgctcggcgccgacataggccaaaccttcgtgatctgatgagctgaccttgtcattggtgaggaacgctccccacaccaggtcgctcccctgataatccgtggagagtgcaacggcattcttcgagatgtccgtcggactgagcatcactgcggagtctccctccaaatggatatctcgggttccggccggctcgccatgttcatcgtatgccgtgagcgacaactcgatcgatttagacgaggcgttgaccatgctcacatgcgcctgtacctccgcgggcagcgccaatgcagattgggcataggggctggccgcattcacgaaggcgaaatcacgcgatccgtcatcggatgcgtcaatgccggctgcggcctgaaagtcgacatcactttcgacgagcagggccaatgcatcatcgggaatgtccttcaattcgacgacgttcacctcattcgccttcatggctcgcttccctgcgcttttgacaccggattgcgtgatccacgacaggttgagggaagccgcttgggacacatatgctcgcagtgtcatcgcattgcgggaatcccccatattgacaatctgtgtggtggaggcaggattcaagggcaacgtgaaatcattgccatcaggatcaaggcccttcatcgagaccgttcgtattaccgacgccaccggcgacccctgcgataccagattcactcggagggcatcctgattaggtgccgcggctgccagatccacggtcctctgttcgccggcgccaaccacgacactgctttgcgtggccatcacaatctgcccgggttccgtccccgtcatggaaagctgcacagtcgtcgacttgtctgtaggattcgcgatgagcagttgctgggtggtgccctccttcgtccctgaaatgaggaagctctggttcaattgcgtgttgatgcatgtagaggcggccacaccggcgatatcgccattgctcgcccaagaggccatggatccactcgcccctgttcctgcactcgctcccagcagtctcgtctcgaacacctgcggggcttcggcggaatcggatgacgccaccacgaccgaatccgcagtggaatccgcatcatccgactgtggtccctgcaacaccgtggatttcgaatcgtcgcccaatggggaaacctgtgcgtggaaaatcgaaccgaaggccgcataccgtgcacttgaagccagatcccccacgctagcttggaattccctgtctccgtaagtacccgtatccgccagccccatctgcgccggacaatactggtccatgaccttcggactcacttcctgcaccaccgaggcattagccggattggcgttgccgaaactcagctgccgcccggggatgaaggccatgaccagtagtgcgccagccaccacgcatgcggaaaccgtggtggcagcgactttcgtcacctttgaatgcttggatgaaccggactcgaagtgcttgctcatgcttcctcctcgttgctcgcatgggtgcgtggaatggcgacgatgcaatacaggaacacgatgattccgagacaccacaaccatgcgatcctccatgggttgtggctctgctccacaataccggcatcatcaatgtgctgttcagcgggtggattcaaggtgaaccggtaataggttccttttgcattgctcaccacggactgcactccagagcaggaggtgatgttcgccagcaactgcgcactggctcgtccgctggcatcatgaccatcggtgaccacatagatacctccaaaccccaaatccgagagctgaacgatcgcatcatcgtcgttctgtgccagcaattgggctcctgcacgggctatcttggtttgatccgcaccatcagcgaaaccttcgacggcttcgcgggcacgctgcgcaggcgatgagtcgatgagatcaccgctacctgtgcgcatcaccgcatactcgatcgtgtcagcgcctgtggcctccaacgccagaatgcgccggtttgcatctgcacgcaaatactcctgtgcgacctgcggcagcgcatagtcgctttggcctatgccgtcacggtaggcaatctggtagccataaaatattccggcgaaggatgtcaaggccaatacgaacgccactgccacacgacctgcgatgcgagccggaccatttgaaacatgctccacagcaagacgagtgaattgctttgtgcccgcccctgccaacacagcaacattggcgatgatgccacacaacgccatcgcaacacctggcagcacagagccggctgccggaccatatggctctgcggcaatcaccactgccgcagaaaccattgccagcagcagaccgcatagagagactgtccacaggattctacttgcgcggaacaccgaaggacgtagcaatgcgatcacggcaagcatagtgataaggcatgcggcaatgaacagcgccgcgtcacgggcgccattcagcgtgaaccatgtgccccattgcgtgggaggagcaatgccgaaagcccgccatgtcaactcgctcaggttcatgagacggggagcaccattgacctgctcgacagggaccatgacatcgccgaacaattggcgcatcatgccattgcccgcatagcgcaccgtattcaccaaagtgggggcgatggcgaatgcagacgggaaggggatgagcaccagcatcatacggtgctgacgcacgaacaccagaaaagccacgaacacgacgatgagagcgagcagcaattgcggctccgccgccaccgccggaatgaacatgagcgcggcggcagcggcagcctgcacagaagcgcggggattgaccggctgttcggtgcggtacatgcccacagctttgaaacatagggcgaaagcacccggcaggaacaccatgacggtcagcatcggaaggttcgcgctggaatacaggcccagcgacaacgccgtggcgaaccacagcaggccgcagaacacacgaatctcatcggaacgcgtcaccacgcccgccagtgcccagaaactcaagacgcatgcaggagcggagaggaagaagatcgacgtcaccgccgcagccacatgaccgccggtgaacactgacgccaccatgagcaccagaagccagggggcgggaggcgcagccacaccggtaccggcaccgaaattccatgtggtggtggctgcctccaccagctgccggaatgtggcatcagtggccggcaactgattggaatacagtgacccgccggcgaatgccggaccgaacaatggccaatacatcaccatgagacagaggaatgccactacggaggcaagaagggcgtacgtccagcgacgtatgagtcggcgatggagatgggactgcgccaatggatcaagcaccacgccatcctgttcatcagcaaacgctttgctgcgcgcattccagatcttcagttgggccctgtctgccaccagattcgacagctggcttcgggatatggcctgaaccagtttgagcctatgacgtgccaccaatgcaggcggcacattcaacaatgccagcaccggcatacacagcatgcaccacgcacggtaaggctgtttgcgaaacaggagtctgagcgcttggaataggcatgcaaacacactgccgacccaaagcagaggccaccagccggctgtgacatcggtgtacaggtatttctgctcgccactcaactgtggcatcgatgtgtcgatgatcctgccgtctgaggtgggctgaccgtcatgggtgcgaatgccttcgaaccttgcacgtcgatgcgcgatacgggccgatggaacgactaccacgcgtttgcctgctcgacataggcgccggcagaaatccgccgattcgtcgtaagtggtgaaccatgcattaatgccatgcatactgcgccatgtgttcaccggaatcagggcgccggcgagggagaccgcgaacatgtcactgcgggagtcgtactgttcctgatcgggctcaccgtccacgaccaacgacaccacctcatggtgtgatgcatatttgcctacatcgtgcagacgcacggcatcccaatccaattgtttgcagccgatcaacgcggcagtcggcgtattcgtccacgtgtcgagcagctgttccaggcagatcgggtcagcgggccgtgaatcgtcgtgcagcagccataaggtcttcgccgccgtatcaatctgcgcattgcgcagtaccttcgccaccgcatcgccgaaggaacgcgcctgcgccaccttgagcacctgcacatgcactgtatgctcctgaggaacaccatgcagcgcatcagcctgcgtggggatcactttgaaactcgtctgcaccgattgcagggtctgccctgagcaatccgcaatcacaatggtcgacggcagtacgctctgtctcagcacggcggcaagggtgtccgggaagaatcgcatgtcgctctccaccgtaatcaccgccaccacatcgtcacgcaccgtttggtcgtgggaatagggccgttgcgccaaggtgtcgctgatcagctgctgaatctcgctgtcgccggaaagtctcatatacgccagtgtacgcaacagggtctattcaaggcatcttggggtgaaaagcgtgcagatgcgcccattcccatctttttctcaagcgagtaccttataatcatgaaactgaatcgacatgtacgtgtgcacgcagcgcgcgggcggcgccggcactccccggcggagacgacgaacagaaaggtatgagctttggcttcacataccgacgacagcaagcgtatcgtgaacatcggcggtcctgttgacgagcatccgcggcacagcaccgtgcaggtcaggcacgtgcgataccggatcctcaagatcatcgcgatggtgctggtcgctgtgctcgtgttcgcgggctctgtggccgcggccacctggctcaacatcaacaatgcggtgcagagcggcaaaatcagaagtctcatcgagggtgagtcagacgaagacgcctatctcgatcccaattcaggcaagccaatcaacttcgtgctcatcggccaggacactcgcgatggcgacggcaacggtgacgtctccggtgacggggccactgagggagggctacacaacgccgacaccacaatggtggtgcagatcggggccgacagaaactatgtgaatctcgtctccattccgcgagactcccttgtcgacgtgccggcatgccatacctccaaggagacgattccggcccaatacggcgtgcagttcaactcgatcttcgcgaatgcctattcggtgggaggtgacctctcctccgccgccagctgcacggtcaacgccgtgaatgcgctgaccggacttcatatcagcaacttcatcgtcgtcgatttcaacggtctgagcaagatgattgattcaatcgacggcgtcgacctgtgcttcccctccgacgtggacgacccgaacacgaacatgcatctgaagaagggcatgcaccatctcaatggcgtggaggcgaccaattatgcacgccgtcgccacggcaacgacaccgacggctccgacatcatgcgcacgacacgtcagcaatacctcatcaaatccgtgttgcagaaggccatctctcggaacctgttcacgcagaccagccagctgtaccagctggtcatgaatgcaatccgttcactcaacttcagctcgggcatggccgataccaatgcattgatgggtctggccttgagtctgcgcaatctcaaggtcgaccacctgtattcccagactgttccgatcatgtcggcccctcaggaccccaaccgcgtggtttggaccgaggatgccaaggcggtgtgggccaagttcaaggaagccaagccgttattcggttcagatgactccgcgggcgcagacaagcaggaggaggagcaatcccaagtttccgtttccgaggagccgacggagcccgcgcagaccgaagacccctcaccacagccgtccgatgactcgggttcgtcgagtcaggaggagaagcccaggcttgatgagaaaaccgggctgctggtgcatcccgatggcatcttgaccgaccctgagaccggtggcgtggtggacccggacgacggatcgatcaaggatccgaacacgaaccaatacgtcggcatctcctatcgttacctcaacaacactatctgcaaagtgccggagcacagcgacgactgaaacggcgaaggggtcggcccgatggccggccccttcgcattccgccggatctcgttggtccataatatcggtatatcttggcaatataggcttctcaaggaaaatcagcaggcgagggcatatgacgaacaacaatgctacaggcaatgatctcccaccgagctttgccccttcccattccaagaagggctccgcgcagcctccagtcacatcggcgcccaacgcttcctcgccaacgccccccagcttcaccccaggccacatctcatcaccccataatggcagaacctcctcggccgtgcccgcatcattcaagccgaagcacaaccgaaatccgcgcagctcatcatcgtcatcctcggtggttggttccgattccccccgacagccttcccccacaaccgcgccatcctatgccccacgccgctcaccaagtcggcaccaacactcgcatcagatgcctacgaactctcgaaatggacgattccccgcaccggccgccatgcgtaatacggcgaccgcagcaaccaggaaaccacaccgcgtgcgcaacatggtacttggtgtgctgcttgtcatcgtcatcgtgctcggcataggcggcatcggcacctacgactgggtcaattccaatctgcgcaaggaagcgtggcttaccacaggctccgacactcccggtacctcctggctcattctgggttccgatgaacgtgacggcaccaccggtgccgatgacaccccaggtgagcgtaccgacacgattctcatactgaccaagccgaagcacggaccctgctcactcatctcagtgccccgcgattccctcgtgcaggtcggcgaccaaatgctcaagatcaatgccgtcatgcaggtgttcggcaagaaggaactcgtgacgcaggtggaatcgatcactggtcagcacatcgaccatgtagccaagctcaccttcggcggcctcaccaaggtggtggacgccctgggcggcgtcgaattgtgctacgaccaggatgtggatgacgagaaatccgagttgcattggaaatccggttgccatgtggtggacggtagaacggccttggcgttctcccgtatgagatactcggatccacgctccgacttcggccgttccgaccgccagcgccaggtgatcggcgccatcgcacagaaggccacagcgaaaagtacattgctcaacatcgggaaactgaagaaagtgggcgaggccgcacttggctccctcacggtggatgacaaatccactccatggacgatgctgcagatgctgctcgccttccgcgacgcctcaggatccaacggcatcaccggaagtctgtactggacagatcccgggtattatgtggacggcgtgggttccagcgtcttgctggacaaccagaagaacctcgagcttttcaagcagctgcatgacggcgaccatgccccgggtcaggtgggctcaacctccgaacaacaatagttatccacatacccgggtcgcgcttgattcaccccgataaccggcgcatagtggacgcatgggcattgaaacaccatatcgggcggtgcgcaccgcagtcggccggaaacggtggaggcacaagggacacctcctgcgtgcagccatgcctgctctcgcccagatcatcgtgctgacggcgttgctgttgcaacgtcaatggctattcgccctgatggtctcttcaggcatattcggcatgctggcgtcatttaccctgacatacacccccgattctccgcatcactctcccccgatcggatcatacgaatcggatggcgcatgcgagcctcatcaccacaacatgaatcgtattgcccgcatgcccacaccgcgtgatcgggacttcatgacgatcttcggattcggcgatgacgaggctcccatgcgcacaatctgtcatcgatggtgcgtcgcatctcatacctcggggctgcgggcgactcttggcgtagatgccagcgggaggccgctcagcgtggatatcgacagcgaagggccgcatgccattgtggcaggcaccacgggttccggcaaatcggtgctgctgcaatgctggtgcctggcgctcgccgtcacctacccacccgacagactcggattcgtgttccttgacttcaagggcggttccgctctggatcggctggccgcacttccccatgtccgtggatgcgtcaacgacctcgacctgtcatatgcctccagggcattgcgtgccttggaagatgagctgtcatgccgcgagcatctcgccgcccgccatcatgtgagcgatatacgtcagctaccggatgcaccggcacgactcatgattgtcgtcgacgaattccatatgctcaatgaacagttgcccggctatatggacagactgcttcgcgtggcctcgctcggtcgttcgcttggcatgcatctggtggtgtgcacgcagaatccgatggtggagatcaacgcctcgatgaaggccaatatgagtctgcgcatatgtcttcgagtccaggatgccatgcaatcccatgagatgatcggatcggcactggcttcgaccattcccgtggattgtcccggaacggcagtgctgaaccatgagggtgagtgcgtgatattgcagtgtttgcagccttcgaatatcggggcattgaccgtgcagatacaccaatccgcccgttttttcggtcagacgaaccgtgcgatgctgttcactcctccgttgccatcggacatcgatgaggatgaactgtcctgcatgcacatcgacgcatgcagcgatgcctcacgtatactcattggcgtcgcagacactggcgtctcgttcgaaccggccttcatcgacctttgtgccggttccgtcgccatcatcgcaccgccacaccgcggtgcgcatacactgcttgaacgcatccggcgggaggccatgcgtcacggcacaccggtggactgtttccccgatgcggatgaggccttggaaccgatgaagtatatgagcggtgacaatgccctgcggctcagcatagcagacacttccacgctcaccgtgttcagcctgcgcacctcacgcccactgcgcattcccgaccatgcgtccgtacgcatcgtgttcgcctgcggagacaggaatgccgatcttgcggatggcatccccgccgacatgcttgcggaccatgcgccttccgagttcatgaggcccggtcgcgccgtgctgctggaacaagggtgtgcccgacttattcagtgcatacgagacaggtcgggaacatgatattttccgccttttgatcgaaacccttgaaaaatccatgacggttgcatagtatagcgatttagcgttaccactcgagcgtgaggattgacatgagcagtgctttcgattggcgtgccaaagctgcatgccgtgataaggatccggagcttttcttccctgtaggcaacaccggcgcggcctaccagcagatcgaagaggccaaagcagtgtgccgcacctgcaaggtgattgacgcctgcctcaaatgcgcccttgacacaaatcaggattacggcgtatggggcggtctgagtgaggacgaacgacgcgccttgaagcgacgcgccatgcgcgcgcgtcgctcccagtcgctccagatgcagatctgagcttctgcgttcgcatcccctatgcgcaaggtgcccggcatccaattggatgccgggcaccttgcgcataggggatgcgtcatctcaggccgcacgcaatgtcatgtctagaatcactctggtgccaccatcacgcccatgttcccagcgcacattgccaccgaagtcgttggtgacgaaagtgttaatgatctgcgtgccaaggcctgatcctgaggccttggccatgccgttgctctcctcctggtccatgccgttgccatcgtcttccaccacgacattaagacatttgccctcacgccccaccgatacggtgatgtgcccctccttgcgcccatcgtaaccatgttccacggcattcgtaatgagttcggtgagcaccaacgacaacggggtggcgtcctgcgcgggcatcttgccgaatttgcccacgaagtcgatggtgatgtgttggtcccgcatcgaggccaggtcgacgctcatgcgcagcagattggaaatcaccttgtcgaaatccacgttctcgtcggcggtctggctgagcccctcatgcaccatggcgattgtctgcacgcgacgcatggcctcttgcagctccttcttcacctcttgggacttcgtcttacgcgcctgcagtctcaacaacgcagacactgcctgcaggttgttcttcactcgatggtgaatttcagaaatcgtggcatccttcgtctgcaactccacttcccggcggcgcagttcggtgatgtcacggcacaatacaatggcgcccgtgcgcccatggccgtccatcaacggcatagaacggatggagaccactgagtgattcgcattgagttcggaatccaccggcgccttgcccaacagcaccaacggcaaagattccggcaccggatcgttctggtgaatgagacctgcacccacctcaccgaggttcttaccctgcatcatgtcgaccatacccagacgcctgaaacagctgatggcgttcggcgatgcatacgtgacgtcgccatccaccgtcaggcgcatgaagccgtcggacacacgtgcattatgccgttggttcatcacggcatcgcggtatgggaactgctcgcgggtgatcatggcgaacagctggcgccccacctccagactctcccattcataccggccattggattcccggttctccagattcgtctcgcggagcaccaatcccaaggtcttaccgttgtgacggatgggcgcataggtgttgcagatgttcatcccatcgatatgctgcagattctgcgacctgtagacgccatcatgctgcatggcggcctcacattcgttcctcatccatgcatcgacctgctggcccaccacatcgtccacccgcatgctcaccaccgtggatggcctgcactgctcggcgaagatatagcttccatcgcctttctgcaggatgagcagaagatcggcgaagctcaggtcggcgatgacctgccaatccgccaccaaatggtgaagccattcccgatcgctgtcgtcgaaatccggtcgcgtcgcgagtatctgtgaaaaatcagccatggcttcatcatagccagcaacgcgcacaagaacagctacgcatatacgcagtgtaaggacgtgccacctgtcattatgctacggtatcgtaacttacggtagcgtaggattggaggtaggaaggagacggcatatgacaccggagcaagtcgaacgcaagcgcgcagccgtgatcgaggcccgtgaacaggcattggaggcgaaggcgaatctggtgcgtacgaaagcgcatgccaaggccgagaagattcgtcgcaaggccgacaacaaggcgaagagaacgatagccaagggtgaggagcaggccgccaagctcgagggaatcgcacctcgggaaatcgagcgcaagatccgcctcgatgtgcatgggcgagagaagcccgccatgcgcggttggattcacgcaggcgccgccccgttggccatcgcggctggcattgtgctcatctgtctggcccatggggcggcactcaaatgggcttgcgccgtgttcatggcatcctctgcattcctgttcacgaactccgcactataccatctcggcgactggtcgcccagggtcaccgacgtgctgcgccgcatcgaccatgtcaacatcttcctgctcatcgccggcacctatacgcctgtctccttcgccctcgacgatttctggcgcaaggcgatcatcatcggcatgtggtcctgcacactcatcgccctgatcattcatgtggtgtggatcaatgcaccgcgttggctctatgtgccggtctacatcatcttcggcgtctccggcgtggcgttcatgggcttgttctggacgtcaccggtggccggtcctgctgtggtatggctgctacttgccggcggcgtatgctatatcgccggcgccgtcgtctatgccaaacggtggcccgacccatggccgaaagtgttcggcttccatgagatattccacatcggcaccgtgttcgggtatgcctgccatgtggtggccatctacttggtcgtatgccatctggccgccctcgcctgacgggcctctctaccagccgggaatatgggagggcccgcgaacacatgcatgtgttcgcgggccctgccatattcccggtatcaattcaatggctcggattccttgatcgtgaccgagatctcacgaccgttcggcgccttgtatgtgaccacatcccccaccttgtggccgatgattgcaccgccaatcggcgactcagggctaatcacatcgtaatcggtggccaccgtgatgtcacgcgaaccaatcacgtactgcatctcattgccacccaactcgatggtgaccaacgaaccattgcccacctcgccggccttgggcgcctctatgatcttagcattgcgcagcttgacgatgagttcgttgatacgcccctcattcttgctctgttcctcgcgcgcggcctgatatccgccgttctccgagaggtcgccctctgcgcgggccgcggcgatgcgttcggtgatctcgtcgcggtattcaccctcgcgatgagcgagctcctccttcatcttgtcgtacgcctcctgcgtgagcagcacgaccttttcttcctgttccatatgaccctccatatgacgcggcttatgccgccattgtacagcaagggcaccggcattccaccggtgcccttgaaaacccgttcgctcagcgcgtggagatgatgtccaccacgaacacaagcgtgtcatcgccgccgatgccggcctgaggcgcaccgttggccccatagccgtattgcggcggaatcgaaatgagcagacgcgaaccaacgttgtgccccggcacggtctggtcccaacccttgatcacctgtccgacgccaatgccgaaactcgccggatggtgcctttcgaagcttgaatcgaacgccttgtcgttgccccacacctgaccatggtagttcacggtcaccgtgtcgccacgacgtacaatcggcccgttgccctcttcgagctccacgaccttgagcccctgcggggcctgctcactcgggaattcgatttgcggcgtatcgccgaatgctcccttgaccacaggcatatctgttgccatatcagtctcctttgctcggaataccacagcctagcatacccccgtcctagcatatgcgcgcatttcattcaccgccgcacgcaggcgctagcattccaccacattcaaggcgaggcctccggtggcggtctccttgtattttgccatcatgtcttcaccggtgtctttcatcgtcttgatcacctgatcgagggtgacgatatgcgtaccatcgccgagcatggccatacgcactgcggatatcgcggtgttcgccgctatggcgttgcgttcgatgcatggaatctgcaccaatccggcgatggggtcgcatgtgagtcccagatggtgctccatgccaatctccgcggcgttctccacctgccgaggatttcccccgaccacagcgcacaggccagccgcggccatggagcatgcggatcccacctccccctggcacccgacctcggctcctgaaatcgaggcattgcgcttgatgaggtatccgattgccgatgcggtgagcaggaacttcttcacccccgccatattcgcattcgcgatgaaatgccaatagtacatgagcactgcgggaatcactcccgccgaaccgttcgtcggcgcggtgacgatgcgtcctcccgccgcgttctgctcattgactgccagggcgaacaaatcaacccaggcctcgttcgacgactcgagctcccgcacgctgtcggccgccggctgattgagcaggtctccgctgcccgcaagccggtcatacatggcgggtgcgcgtcgcggcacattgagcccacccggcagcaccgcttgccggctggtgcatccttcatggatgcagtcgcgcatcgtgcggaacaccgtttcgatatgccggtcgatctgttcggcaggtcgtatggcagtctcattcgcccagacgacctcgtctatgcccaaaccggtacgtacgtatatgtcgatgagctcggacgccgtggagaatgggtagggcagcccagccatgctgtcaccttccaccgacaacgcggtctgctcgctcatctgctcctcggaatcacgctgcacggctggggggacttccgcgtgaatcggcacaagcggatccgtggccaaaccacgttggatgaatccaccgccgatcgaataccacacctgttcgagcagttgctcaccgtgctcgccatatgccgtgaaccgcatgccattcggatgcgcggcgaaacgtcgccagtggtcgaactcgatatcgcgtccatattcgaatgcgatctcgtgttcgccgttcagattcaacgtgccacgctcatcacagatctcatggatgcgcgcgagataatccgtatccaccgtcttcggctcgttgttttccaacccgaccacggcggcacggtcagtgccatgcccgagtccggtcaatgccaacgacccatagagcgtgacatgcacacgggtcacacgggcaagcagatgcccgtctgcgagcgccttcgagaaacgctgtgcggcgagcatggggcccacggtatgcgatgagcttgggcccacaccaacggagaacatatcgagcacactgaacacacacggcattgtacacgcgtctgcgagcgacaagccggttcagaggggatcaggcatgcacggactggtacatcgccgcgaataggaagcctccagcgatggcgagcaatacggtgatcacaccgatggcgatcatcaccttcgtgtatttggcgaggcgctcacccagcgtggatgcgaagaagaacgaggcaaacccgagcatcgcgccattgacaccggcgactatggtgtcatggtgcgacacggtttggccgagcaccggccccgcgatcatgttcatgaatccgagcacgacccaaatggtccacacggcgaagccgacggcaccgataagcgaatagacgaccggctgcagtttgcgcttcatgcggtaggcgaacgattcagcgcaccacagcagcgcgaagcccacgacatatgcgaacgcgacggcgagcaacatggccacaagcacccatgaaccaatcgggaacagaccgggtgtgaatgaaaggtagatcggtgagcatacgagttcgcacacacatagcgtggccgcgatgatgatggcctgcacgagcatgaccggcatgccactctccccgtgcacttggacggagctacccgcaggagtgactgtggactcgtgcgtattcgatgccttgactgcggttcccttggatgccatgttcctcccatgccctggagcgtgatctgtcatatgagtgtagggaacagatgtatcaggcagttttcgaacatgcgaagaaccacaaggttctcacagtacggacatatggccgtactgcatgccgtgtctggtgaggaggtgcccctggcgggactcgaacccgcaagccgaagcgaccgattttaagtcggctgcgtataccatttcgccacaggggcttcggggcgcacgcgtcccgagacagacattatgtcacactcacctgatttacgtcgatcacgggagtgcgccatatcggtgttcagtgttctgtagggcgctcgttgcaggtctcaagcgtcctgcgacccagatcgatgatgagcccgtcaagcaagccgtgctcgctggccacgtaggaatcgatgtgctggccgtggtcgagcaatgcagcctcggccacgcgggcaagcacacggttccacaccagcgcgccgccgccgacaacgtcgatacgtccaggatggatggtcttatgagtggcacgttccgcacgggtcatattgaggaaccgatcatcgacggcgaacgcggtttcgaagtccatgcgcacaccgtccacagccacatgattgtattcggtcagtcccatggcgagtgccgtcatcgtggtcacggtgccggagacaccgactatcgtatgcgtcctgccggcaggcacatgtcggaatgcctcggtgatatgcctgtcgatgtcatgaactgcttcgtcgatctcctgctcggtcggcggatcgtgatgaagatggcgttcggtcatacgcaccgagccaatgttcatcgagaacgccgcctgcaccttcgtagctggaagcgtatcgccatcgccaccaagcaccagctcacatgaaccaccacccagatcgaccaccagatatggggcctcgacgtcaggcagcgatgaaatggcactgctggctgccaggaaactcaggtccgcttcctcggtgcccgagatcacctcggggcggactcccagaatggattccaccgtgttctcgaattcctcgcgattgtcggcatcgcgtgtggcggaagtggccacgaagcgaatggcgtccaccgcatgctcatcaagaacgtccttgaattcgcgaacggcggcataggtgcgttccaaagcctcatcggagaagcggtgagtctcgtcgacaccctgccccaagcgcaccacgcgcagcattcgcggcacgacgtcagtgaccccatgctcgtcgacccgcgcgattttgagtctaatcgaattggttccgcaatcgattccggccactgtcactgcagtcatctctacctccctctcgagtcacgcatacggccgatgccgtcagcgtgtctcttgtccgtcggattgcgcccgcacacatcggcataccgtcggatcgaactcattgcgcatgcgttccaatgccatatcgccgatcgggttgacgccggggcccatgaccagcgactgtgccaccaaggcgtgcaaacacttcacacgcaccggcatgccaccggcgcttataccttcgatgtgctcctcactctcattcagccgttcggcaagaccgtggcggaatgccaggtacgcggcatgcgccctctcgtattgagcacgcagattggtatcgtcggcaagcatttcgttgtattgtctcatgagtccatcggcttccagatgcgatacggccttcaccgcctccggactggtcaggtacatggtcgtggggaatggaatgccaccgggcaatacaggccctgtgatcaccaccagcggggtgccgtccccgacgcaacgtgctccgacagccaccatgccacgcggatacctgccaagctgggtctcgacggtggcgatgtcattctgcgtcgccgggtgctccatgacccgctgcaatgtctctgcggccaatgtctctatgccgttggcgttccggccttctttgctcatgcttccttccgatcttggtcagggaatcgaacgggccatcgcccgcatggtgtgtgggtatgtcgaatgcgctactgccctgccgaaccgccatcctgcggggcatcggtgcccgcggtggcatcagggtcattctgttgccgcgattcggcggtgttgccattattggtggcatcgggttttctggcatccgattccttgaacgaataggcgagctcactgtaccagggcaggttcgattggcccgtttccgtgttcgcattggcatcggacttcggctgttcgccgctcaccgcctcgggatgctccaccttgatcgcctgctcccctgggaacacatacccgagccgttccctggcctgggcggttacgtatgcagggtcgtcccagcgggcgatgtcgttttcgagatccttcttctgcgccgcgagcacggcttcctgcttcttgagcgagttcagctcgctcagattgatcgcatacgtgtggaatgcggagatgatctggatggagcccaccgcgatgacgaacagtgcgatgaagaatgcgatggggccggtgttcgctcccttcgtgtgcgtccgctccttcttggacgaggagggcgcagactgtggtttcgaaacatgtggccgcttgctcataggaacgaaaatacccgccgcattcgacgtgcggcgggtattagcgaataaggtccctaaggacgggtcacccggtcaaaccagaatgcgtttcgaatcacatgtacttccggcatgccttgaatgcgctgtagccagcgtattcggcggtcgaaccgagctcttcctcaatctcgagcaggcggttgtacttggcgatgcgctcgccacgtgccggggcgccggtcttgatctggccggtgttcttggcgacggcgagatcggagatcgtggtgtccggcgtctcgcccgaacgatgggagaccatggaggtgaagccgttcttcgtggccagctcgatggcgtcgagggtctcggaaacggtgccaatctggttgagcttgaccagcagggagttgccggcgcccatatcgatgcccttcttcagacgcaccgggttggtgacgaacagatcgtcgccgacgaactgcaggcggtcgccaagggccttggtgatcttggcccagtcttcccagccttcctcctggaacggatcctcgatggagacgatcgggaactggtcgacgagcttctcgtagaagtcgagcatgtactcggaatcacggtcctcaccatcgaagtggtacttgccggtctccttgttgtagaactcggaggaggcgacatcgagggcgatgccgatctgcttgcccggctcatagccggcggcggagatggcgtccatgatgtacttgagggaatcctcgttggtcttcatcttcggagcgaagccgccctcatcgccgagaccggtggccagaccctgcttcttcagcacgttcttgagggtgtggtacacctcgacgccggcctgcagagcctcggagtaggtctggaagccgtacggggagatcatgtactcctggatgtcggtggcgaagtcagcgtgtgcgccgccgttcatgatgttcatgttcggaaccgggagaacatggccgttggtgccgccgatatagcggtacagcggcagttcggcgctctcggcggccgcataaagggcggcgagggagacaccgaggatggcgttggcgcccagacggcccttgttcggggtgccgtcgagctcgatcatcaggtcatcgagtgcgcgctggtcggtggcgtccatgccgatgaccttcggggcgatctcctcgttcaccgccttgacggcaccgaggacacccttgccctgatagacggacttgtcgccatcgcgacgctcccaagcctcggcttcgccggtggaggcgccggagggaacgagacccaggccgcgagcaccgtcatcggtgtcgagcacgacctcaacggtcgggttgccgcgggaatcaagaatctggcgtgcgtacacgctttcaattgctgccacaacttctccttaatgtgcataggttgtgatgacagtttccagcgtaatgagattgttggacgattggcgggagcggatcagaaaaaatgtgagcgctcccacgactcttttcgactgcgacacgcgtattgtccgagccttccgacaacgtgaacagcgacacggggtgcccgggccatgaccttcaaacatgctggaagcgacgccaaagcgggtcggctgggctgagatcacactcgttgaacctgacatagacaatgctatcgaagggaatgtcatgacccagtctgcaacgaacgagtccgggaacccttaccgggatgccagttcgatgggcacgaccggtgcaccggcacgctccgccgcatacgccgtgcccgcagccgaacataccaagactgcgagccggatcggcacgcgattcattccgtggcatcatggccgcgcaccccgcttctgcgcgctgtgggcttccacggtgctcatcgtgctcgcgtgggccttggccaccggaggaccggcgcacaaccgttcactgccctcccccggcgaagtgtggcaggcgctccttgcgttgcacagcgaggggctgttgctgccatccataggcgtaagcctctacagagtgtctctcggcgtggccctgggtgtcgtgacggcggtgccagccggcatcatcgcagggtcaagcaccattggccatgcaatcatggacaagcccatacacatgctcagggccgtgccgttcccggcgctctccccactgctcatcgtgctgttgggcattggggagacgatgaaggtggcattgatcgccatcggcgcgtttgcgctgatctatgtgaatgtgcgcgacggcgtgcgcggcatcgatccgaaactgctcgaattggcgcaggcataccacctgcccaaacgcaccgtgttcgcgaagatcctgctgcggggcacgctcccgcgcttcatgacggggctgaggttcgcactcaccgtgtcttggatcgcgttggtgacctgcgagacggtgaattcctcggcaggcatcggctacattctctcgcgttcccagcagttctaccggaccgaccagatggtgctgtgcattgtgctctatgcattcctggggctgttcagcgaatggctggtgggtgcattggaacggctcgtcgttccatgcgcacactgatactccatatagcggcaatcaggttcacccttacaatgaccaatcccatgagacatatgggtacacccatatgcacccaaacaaggagaatcatgtcacgatccaccatgctcagattcacgtccgccgcatgcgcagcgttgctctcactgtcatgctcggcctgcggcgaaccgaatgccgcggattcctccacgaccatgcgcgtggcctatctgtcgaccgcgaattacctgaccaccgtacgcggcgaagactttcttgacgagacgatgcagcacaccaacgtcaaattcaccggcccatacaacccgacggatgcatactcagcagtgctgtcgggcaatgccgatgccacgagcaccggcaccggctcgtacatcaacttcgtggcgcaaggccaaccgtgggtggccttcgcgatcgagtattacaccggtgattcgcaaggaatcgtggcctcgccgaaatctggggtgaactcacttgaagacctctacggcaggaacgttgcgatcataaaacgcggcggcaccggcgattacgtgctgcacaaggcattcgagcatgacggactcgatgtaggcagggtgaacatcgtcgagatgagcccctccaatttccaggcggctttcacttcgggacagatcgacgcattgagttccttcgaccagaatctggccgccgcaatggcgaccccgggcgcgaaactgctcgtgaacgcaacggaatacgggaataagaacgtctcgattcatatggtgtcgaaggatttcgccaccaagcaccccgaagcggtgaaagcgatgtatcgggcgctcgtcagggaatccgacgtggcgcaggccacgccgtcgatcatcaccgacgcataccgggaattcggcgcatccgatgacgtgaccgaacagatcgcaaggttcaatgtgccggtgatcaagccgattgatgcagagggattgaagatgctggaatcccaggcgcaggagtatgtcgatttcggattcattgacgcaatgccggacttgcaggcggcgtcaatggattgctcggcctgattgcctcatcggaggttgtgggggagccggccgggaagccttgcttcgtcgaggtgtctgcatggcgcggctccgctgcgtcggcagcacgctcctcagcaatgcttcccggccggctcccccacagcctccggcatatgcaggttgttcgaattggaaagggagtgtttccatggcaccagttgtgaacatggactcggcgtccaagatgttcgacgggcgccccgtgcttcgcaatgtgaccctcacgattcgccaaggcgaattcgtgtcgctcatcggacgctcgggatgcggcaaatcaacgttgttgcgcatgatcgccgggctggttccgccggattcggggcgcatcgatgtttccggcgagtacgccttcggctttcaggatgcccgtctcgtgccctggctcaaggtatgggacaacatcacattggggattgacaccaggcgcaagttccgcaaggaggcggccctgctcgcgttgcggcacgtgcagttgccggacatggctgatgtgctgccccacacgctttccggcggtcagatgcaacgggtctcgctcgcccgcgcattagttcgtcagccgaacctgctgctgctcgatgagccattcggggctttggatgccctcacccgttgggacatgcaggatttgttgctcagattgcggaacgaacacgggttcgccaccatcatggtcacacatgacatcggcgaggccctgcgtctgtcggatcgtgtgctcgtgctgcgaaacggcacaatccgcgaggaactccgtatcgatcgcaccgaagtggacacagacaaccggccttctgatttcgccgcattagaacgtcgactgcacgacgcgcttcacgaataacaccgtctgtgcgtgcgcgtgtctgcggagagattcgatgggtttggatgggtggggcctgagcgaggcgccgttgaggagcgtgctgccggcgtagcgaagccccgccatgcagacacctcgacgaaacgacgccccgctcaggccccacccatccaaacccttccgccgctacttcacaggctttgcagaccacgctagatcgtcgaggagctgctcggtccaacgcagcacctcatccgattccatcggaccggaacccatcgaaccttcgaacggcgtgggtatggtgtacgcgttcaacatgggccggtattgggcacctgggtagatgcgcgagatgcgcagctgcaccgattcggcagggtcgatcttcgagatgcgcagcttcctgccctggccgatgatctcgctgatgccaagcgcgcgtgccttttcacgaagacgcgccacgtcgaacaatgattcgaacacctttggcggcttgccgtagcggtcggtcagttcgtcgcgcaactcgttcagatccttctcgctgcgggcaccggccagtttgcggtagacctccagccgcagcttgtcggaaccgatgtagtccacgggtatcgatgcctcgatcggcaggtcgatggtgaccgcaaccggttccgtgcgttccggatccttgtaatcctcgatcgcctcgctcaccatacgcacatagaggtcgaagcccacgccttcgatgtgtccgctctgctcatcgcccagcaggttgccggtgccgcgcaactcgagatccttcatggccacgtcgaagccggaccccaatgcggtgttctgcgcaatggtgaccaggcgttcgtgggactgctcggtcatcggcttgctcggatcgtacaggaaataggcataggcacgatcacggcctcggccgacacgtccacggagctggtgcaattgggagaggccgaatcggtcggcacgatccacaatcagcgtgttcgcattcgagatatccagacccgtctcgacaatcgtcgtgcacagcagcacatcgatgtcacgatgccagaaatcgcggatgatctggtcgagctgcttacgtcccatcttgccatgggcaatgcctatccgggcttcgggaacgaggtcctgcagacgcttggccttctcctctatgccctcgacacggttgtggatgtagaacacctgaccgccgcgcaacagttcacgtcgaatcgccgcggtgacctgcgcgtcctcataggcgcccacataggtgagcacgggcaggcggtcctcgggcggagtcgccagcgtggacatctcgcgaatgcccgtgacagccatctccaacgtgcgtggaatcggcgtggccgacaggctcagtacatcgacattcgtacgtacggccttgagcgtctccttcgcctcaacaccaaaacgctgctcctcgtcgatgatcacaaggcccaggtccttgaacttgatcttcggattcagcagcttatgggtgcctatcaccacatcgacggtgccgtcggcaagacccttgatcgtctcattgatctccttcgtgctttggaatcggctcatggcgcgtacattcaccgggaagccctcaaaacgttcggtgaaggtctgcagatgctgctgcacgagcagggtcgtcggcacgagcacagccacctgcttggaatcctgcaccgccttgaacgcggcgcggatcgcgatctcggtcttgccgaagcctacgtctccgcagatgagacggtccatgggaatcggtttctccatatcggccttgacgtcgtcgatcgtggtgagctggtccgccgtctcctggtatgggaaggcgtcctcgagctccttctgccacggggtgtccttgctgaacgcgaatcccttggcacgttgacgcgcggaatacaggcgaatgaggttctgcgcgatctcatgcacatgcttcttcgccttcgccttggtctgcgcccaatccgacccgccgagcttgttgagcttgggaatctcagcaccgatgtacttgctcacctgatcgagctggtcggtgggtatgaacagcttgtccggcggcgcattgcgcttgctcggcgcgtattcgatgaccaagtactcgcgggtggcctggttcttgcccgagccggttgtgcgttggcgcatctcgatgaaccgaccgatgccgtgctgttcgtgcaccacgaaatcgcccggtttcaattccataagatcaatggatttgcgtcgtttccgtgccgtcttgacccctgcggcgacactggtgcggccggtgaggtcgcgctcggtgagcaacgcggtcttcgacgcgtggtcgataaaaccgtcttgcgcctgcgaacgaatcgtgtcgaaatgcacgacgccgatctcattgagcatgcgcttgaggcggctcagcgtgccctgtgccgcggctgtgataacgaccgcgtaatccttgcgaatgagctcgccgagatggtcttcggccttctcgccactgccgtggagatcctgtggcgccaccgcatcgatctgcacgtgccccggtagtgactggtccacagtgaacccgctcaccttccatagctcatggttagagtaggtgagctggcccaccacctcatcaagatcaaggaagttcgcggcttcgaaggagatcggcgcacccgcgccatgtcccgatgcggccacatgccagctggtggcgaggaactcgttcgccgtcttcatcaggtcatccactgcacgacgcagccgttccgggtcgaacagcattacgatgcaatccctcggcagcatgctcgaaactggttcgaggtcgtccaccaatgccgggatgagagactccatgccctcctgcgggattgcgttggctatcgattccagaagatcgtcggcattcggaatctgcccgatcaacgattgcgcacgctctcgtatgccctcggtcagttgcagctcacggcatggtgtggcccacaccgacctgatcggttcaccataggtgcgctggtcggaggaatggaagcggcggatcgtgtcgatctcgtcaccgaagaactcgatgcgcaccggatgcggttcggtgggaacaaacacgtcgatgatgccgccacgcaccgcgaactcgccacggtccatcaccagatcgacgcgcgtataggaattgcggacgaggccctgcacggcatcttcaagggtgatttcctcaccttgcgcgaaaacgagcggcttcacgtcacctatgccagccaccaccggctggatgagcgaacgcaccggcatgaccagaatgcgtatcgggccgaacatctcgctgtcggactgcgggtggcacaaccggtagaacgtctccatgcggttcgccaccgtgtcggcgcgtgggctaagcctctcgtggggcagcgtctcccatgccatcagctgtgccacctcattcggatcgccgtcataccacgatcgcagatcgccgacgagatcctccgcctcgcgaccggaggggacgacgatgaccactggcttacggtccgcactggcggcggccagtgctggacgaatgccgttgggagctccgacgaggatgctcgggtcggcgtcctcgcccgcatccacatggccttccaccaaaccggcgaatgcctgatcctccaaaagacgctgcctgagggagaggagcgaaccgttcatcagctcgttgtaggtctcctccgccgatcggttcgcattgctgtgccttgccttgtcatcgggcattgaatttatcctgagctttcgtgaggccttcgaatacgatcgtctccgcggcatctgcaccgtcggcaaggaactcgggaagttgcttgcgctgtgcggcattgaattcgccgagcacccagttgatcgtgttgtcgtgggcgtcgccggatcggctggcatgcccaacacccatgcgcacacgcgcataatcaggggaatgcaggcaacggtcgattgacttgatgccattgtggcccccggccgagccaccggacttcaatttgatacggccgaattcgaggtccatgtcgtcgtgaatcaccacgatgtggtcgagattgatgtggtagtactcacggattgactgcacggcctgcccggaatcgttcatataggtcaatggcttgcacaggaacactttcgccgtctggccgttgagactcatcgtgcctttgcccagatcggcaagtcccttgtggttggcgaaatggatgctccagcgcttcgccaactcgttgaccgtcatgaatcccatgttgtgccgggtgttgcggtatttcgcccccgggttgcccaatcccacaatcagccagaattcgcttgccatgtgctctcctatcctccggtatcctcttgagtcctcgttgccgtcaccgccgcgcgatgccctctactgcgcccttggcgtccaacggggtcagatcgaggcaccaatagctcatgtcgtgcagcactcctctggaatcatacgcagcttcgggcatttcaccgaatggctcaaagccgaaggactccacgagcgcgttcgacgcagtattgtcggagaagatgatggcgcaggccttgcgcatcgcacgcgcgcgacattcgttcagcagcgtgcgcagtgcgaatctgccgactcccctgcgctgccatcgtgcggtcacataatatgccagatcgcatacgccgtcgtaacccggacggtcgtagaacaccgatatggcgccgaatcccacctcctcggcctcaccgtcgccggcaatcgtctcgaacacgaacaccgcatatggatcgacgtgggactcaatccatcgccgacgcgcctcatacgtgaccggcaccgtatcggccgtggaccctccggccatcaccgcttcgttatagatgtcggtgatgaccgcaacgtcatccaccgtggcaaggcgatatctgaattgctgcatggttccagcatatcggcacagcagaccgcgcacatcctgcccatgcgtgaggggcgcggccacaggaccgcgcccctcacgcatgggcatgggattggcatcatgtcacttgtcgagtgccatcgccttgtcgagtgcctcttcgagacgcttctgcgcctctccatagccactccagtcacccttcttcattgcggagtcggcgtctttcatggcctttccggcatcctgcagagcctgcgaaagctcaggattccgatttgtattcgctgtggagcccgacccgtccgcattgtcgccggccgcaccggaatcggacggattcccgccactcccctgattcccgccatcgccggcctgagcacccgaattgccatcgaacacctggttcaacgcctcgttgagcgtattggcgaaaccgacctggtctccgaaggcgacgagcactttcttgagcaacgggtagctggttgcgccggaggacttcacgtacaccggctccacgtagaccaggccaccgcccagcggcaacgtgagcagattgccgcgttccacttgcgtcgagccggattcgagcaggttgagctccttcgacacatcggcgttcgcattgaagttgttctgcgcctgcccaggtccaggcacattggaatccttcggcagctcctgcaggcgtatcgtgccataatcgggccctctgacgcccttggtgcggccggcgtccgagtccaccgacaggaacccggtgagaatctcacgggtgctcgaacccgccggaatataggtggaggtgagcgagaacaccggttcgtcagaaccaccggtctgcaaagtgaggtaatacggcggctgcagcacatcgcgggactgctcgctcttcgattcggtcggatcgaccggggtctgccagaagtcctcgcccgagaagaactgcgaggccgaggtcacatggtatttggccagcagctgacgctgcaccttgaacatgccctccggatagcgcatatgcgccatgaggtcgccggagatctcactcatcgggtggtattggcccgggaagatgctctgccacgccttgagcaccggatcggagtcatcccaggtgtagaggtccaccgaaccgtcgtaggcgtcgacggtggccttcaccgaattgcgcatgtagttgacttccttgtccgtcaggccctgcaccgtctgggaggagatggtggtggagtcctgcgtcgcctcggcaaggtccgtcttctgcgaatacgggtagttgctcgaggtggtatagccatccacaatccatttgacccggccgtccaccaccgccggatacactcgtccgtcaagggtgaggtacggcgcgaccttggcgacacgttccttgggggaacgatcgtagagaatctgggaatccgcgttcacacggtcggagaacaggatctggtcggaaccgaacttgatcgaatagatgagcctggagaagatgttgccgatgcgcgggccaccattgccattgaaggtggtggtggctccctcggaacccgtcggatagtcgaattcccaggacttcgtgccctgtggcgcgccgacgatcgaatactcgggtgcttccggcgagaagtagatgcgcggttcgtagtgctgggtgtcggtgagatacccctgtgtcggaatgccgtattcgaagaactgcggctgcccgtcgctggtcactttgttgccgtaggcggccacgatgccatagccatgcgtgtacacggtgtggtcgttcacccaattgcggttgtcgttgccctcgaggttgatctcccgggccgcgatcaccgtgtcctgattgacgccatcgatgtcatatttgtcgaccgccagcgtgtcggcgaacgtatagtactgcttcatctgctgaagctgcttgaatgtaggcgagacgatctgcgggtcgagcagtcggatctgcgccgtggtctccgcgtccttctgcagggcacccgcctgcgccttcgtggtggccttgtactcgtcggtcttcactgcatccagcccataggcagcacgggtcgcatcgatgttgcgctgaatgtatgccgattccatctcctgtgcattcggattcacgcggaaccgctggagcagcatcggccatagcgtggacagcagtatgccaacgacgagcgtggacgccacggcgatggtgggcacgcgccattcacgccatgcggcggctgcattcgccgtgggacgcgatacggcgtcgtcgaatacatgggtggtcatgagccacacacacagcaccacgccgaggacggccgtgagcaccgccatgatgacggtgacggggatgcccgcattcaccgccgtgtaattggcgccggtgaatcgatcgccctgtgcggtgagcgatgaaaagaccgagagcccttggctcactgcccaggacagcatccacagcaccagccagatgccgatctggcgacgggcacgcttcgtgatggcgaacaaaccgtggccatgcaccggcatcgtgaagcggatgccgcccatggcgacatgcgtggccacgctgaacaccagcgccacgaacatgagcagtgtgaacgcggagacgagcatgcgcagtcccggcagcacgaatacgtagaaaccgttgtccaagccgaactgaggatcgacagagccgaagctctggttgtggaacatgagcagaatctcggtccagttcgcattgaccttggaaccgaaaatgatgcccgcgatcagcgagatgaccaccgccacgcggcgagcagtgcgcgagctcacgctcttgccgatctcgatggtgtcaccgttgatgcggattgtggagccatcggcgaaatcgggacgtgcacgaatggccagagtggcggcaatgtaactgacgagcaccatgagggccgcatagaacacccataggcccacacgggtgccgagcaacgtccagacaacgctctggaagccgagctgcgaataccacatgacgtctgctgcgaatgacgagaccgcgaagaacaacgccactatgacggcaatggccacgacgacggcaatggccacccggcgcccgtggttgccatggggtttcgccggcttgcgagtgatgcgcggagagcggggcgtgccgttgccgcctgcagcattcgaatgcgggggctcgccgtcggtctcgatgttgatgacgatcggatcgtcgtcattcgattgcgattgtgatcgccgggtgccatgcccggcaccgaagaatggatcgaagaaagacattcggccattctaccaatgaacctctccccgaccaagggcgttggaggaagtgcttggtttctcttctgtacctacacgtttgcctatgtatttccagatccttccccctgacaggcgtaggctctccgggtgccgccggtggggcgccggatgccacgcttcgtcaaggtgtctgcgcgcttcgcgcgtagcacgctcctcagcgtggcatccggcgccccaccggcggcaatctgtgcccgcgaactgtacaatgacagcagccatcgcagaaaccgaggacccatgatccagcacaacgacaagccacagccgaaccggaacaggcgcatggtccggattgtcacgaccgtcatcgtgacattggcaatcgtcgccattgcgattggggcattcgcaccggttcgccatgctaccgattccgacacgacgaatggcaaagccgccccgacatcggttcccagccgcacatcatcgccagcccccagcacgaccatttccatgccgcagacagcgtcgccttcgcccacccccaagacggatggcacctcggatcgggccaaacgcattgtagaggcgatgagcctcgacgaacgcgccgggcaattggtgatggccgcattgcaatacggcaatgaccctgccaccttgcaagcgatgattcaggagcagcatgtggggaacgtgatcctgatgggcaactgggtgagcggcgtcgagaacgtggcgcgtgccacacaggcactgcagaggttgaacgcctccaccggattgccaggattgctcatcgccaccgatcaggagggcggcacggtccagcatctttcgggaccgggattcgatgccatgcccagcgccacggctcagggtcagatgccactcgaccggctgcgcgcagccgcgcgggattgggccctccccctcaaacggtccggtctcgccatgaatctggctccttcggtggacacggtgacgatcgaacgtgccgtcaatgaaccgatcggcgcgctctaccgtgatttcggactcgatgcccagcgcaatggcgagcatgctgcagctttcatcgaaggcatgcgcgccggcggtgtgggcagtgccatcaagcattacccgggattgggatcggtgaggggcaacaccgatttcacggcaaacggcattgtcgacgacacgacaaccgagaacggcacggaggtgaatgcattcacctctgcgatccggcagggcaaacccgccatggtgatggtgtcgctggccacctacaaactcatcgaccccgacaatcctgcagccttctcccccgccatcgtcaccgacatgctgcgcagaggtaccccgttcgacggcgtggtgatctcggattccctctcggccggtgccgtgagctcgattgctccacaggatctgggcgtgcggttcattgatgcgggaggggacatctgctgcatgaacgccgcaagctatacgcagccaattctggacggcatacgcagccgcgctgccgcggacaagggttttgccgccaaggtcactgcgagtgccgaacgcgtggtgagactgaaaatagagctcggcttggtgcagtgaaaccgtgaacaggaagcgggtgtgccctatggggcgcacccgctcggatattggtcgtttcagcagcagcagccggtgggatgcaggcgctcatactcgtcacgtgcatcgttgaactcacgcacgctcatcggcgcgcgacctggatgctcggcgcgcagatgctcgacataacggccgtatctcgcctcgccgctcacctcccgcagataccagacgatcgcacgccatacgcggcgcgtcagatctgccatcctggccatcctgcggaaccatcgggatatatgcattgccatatgcacctcatgccagctgtggttggaggccgagcgcgacctcgtcatcggagtcatcgggctccacagacctcttagacggcaacgcacccgtgcgcaccgcatattcgcgggccacacgtttttccagattcgtggcgagcagcccggagggggcgaaccatgcggattgcacgaacggttcctcggtggacatgtcggtaccatactccttggcccgcaccgtattcacgatcacgacgacgccgacgaccaggaacgtggccatcatgaggaagaagaacacggaaagcgctccatcgaggtaggcgttcgacagcgacgcacgcgcgttcgccaatgcctcaccctcgagggtccccgaggcgatctgttcgcggtattttgcggcggcggcaaaatagccgagcttggaatcgaaaatcttctggaagtctgcggtgaatgtcactgcgacatcccacaccaacggcacgatcgggatccaggcataccgatgcagccccttcttgaacacgcatacggtcaccaacatcaggcagccggctgcgagcagctggttcgaaatgccgaagatcgggaccatcgcgttgatgccgccattcgcgtcggagacgcccatgtacagcatggatccccaagccgctgtggcgatgaacgtggtgatgaggttgccgggcttccacgtggggtcggagaacttccgcagcttgcgtacattgcccagcaggtcgccgatctggtatcgggccacacgtgtgccgttgtcgacggtggtgagaatgaacagggcctcgaacatgatggcgaagtggtaccagaacgccatcgaatcctcaccgcccatgtatgacttgaggaagttggccatgccaatggcgaaggtggtggcaccgccggtacgcgagacgatgctctcctcgcccacatcatgcgcggcctgggtcaatgcctccgcgccctcgtacgtggtgccgtgggactgccacgtcaccttcatctggttgccttcgatgtccttgacgttcatgttgccaacggcagccaccgcgttctgttcgggggaagcggaagcggagtatgccgaaccagcggtcgcctcgatctggggcgcgctcatgttcagcgagaaatagacgccttggctgattgtgatggcagcaatgagcgcgatgatggcggtgaacgactcgacgagcatggagccgtagccgatcatgcgaagctggctctccttctccacggccttcggcgtgagacccgaggaaaccgcgccatggaagcccgagagcgccccacaggcgatggtgatgaacaggaacgggaagaggttgccggagaaggtcgggccgttcgattggctggccagcatgctgatccccggcatgctgacctgcggattcgaaacggcgatgccgacgacgagcagcgccaatgtgccgatcttcatcaatgtggacaggtagtcgcgcggggtcaccagcagccagtgctgcaacgctgcggccgcgaacgagtagacaatgagcgcgacgacgagctgcttggcgttgagcgtgaagatgggtgcgagcgtcgggttcgaaacgacccagccaccgccgacaatggcgagcaccagcagcacaaaaccgaggatggtggtctcgatgaccttgcccggccgcaagaagcgctcatagcagcccatgaccagcgcgattgggatcgtcatgcccagggagaacacggcccacggcgagcttgccatggccttgatggcgacgagcgcgaggaacgccatcgcaatggcggtgaccacgacgaggaacagcgagatgatgatgccaccgaacttgcccatctcatcagtggccatctggccgaaggaacggccctgtcgtttcgccgagatccacagcatgagcatgtcttgcacggcgccggcgaagatcacgccgaggatgatccacaggacgcttggcaggtagcccatctgcgccgccagaatcggtccgacaagaggtccagctccggagatcgccgcaaaatgctgtccgaagagcacacgacggtccgcccgctcgaagttcgcaccgtcatgcacgcgctccgcaggtgtggcgttcgcgtcgtcggtgcgcatgatcttgatctggatgcaatacgcatagaaacggtaggcgatggcatacgagcacagcgccacgacgatgaaccagatggcgctgatctgttcgccgcgcgccaccgccagaaccgtccagccgaccgcgcagacaatggcgacaagcgcccacgccaccgccttcttccacgtccataccatcttcggccgaatgccggcaggcaatccgttcccgtcacgaatgattcgcgcctcctcggcgtcgttgtatgccacgcccggcgccggttccgatgccgctgatgtcgcagagaccatctccgtccgacgtttcgggcaacgcgagcatcacgcgaactgcgaattgcacagattcgcatatgccccgtctttcgcgagcaactgctcgtgggtgccatgttcaagaatgtcgccatgcttcatgtacagaatgaggtcggcgtctcggattgcggacagtcggtgagcgatgacgaaactcgtccggttcgccatcagcgcgtccatcgcctttgcaatcgcctgctccgtgcgggtgtccaccgagcttgtcgcctcatcgaaaatgagcacgccgggtctgcgaggaatacacgcgcaatcgtgagcagctgccgctgccccaccgacagattgttcgcttcgttgtcgagcaccgtgtcgagactgaacgcgaacgtaagcgcaacgacgaagatgaacggcaccggcagcatcatcatgatgacgtccgtgatggccacctgaatgttcacgacatcgctcatcgtgcgcgtgaccatcgatgcggtaccgagctggcggaagtcgaagacggacatatcgagcgacgcggcgatcatctgcagcgcggtgacggtcatcgcgtggaatgacatcgcggcggtgcctttgtcgagcagccgcgctgccagggtcggcaccagcaaagcgccgacgacatcggcggccatcagcacgtgggtcagcgccaacagccagccgtgcggttacatgaaacgcagtatgagtctcataattcctcagaataggtagaaaacggcgtcattcgacgaggtctgaaatattgtcccatattgagacatttaatagactatcccctatcgtccccgagtggacaatcgacatattctcttcacaaggcgcccacacccggctgcgaagatcagccgaggaaccacggcacgacaggttaccggcagcgatgtcaccgttcctcatccgtaaacagatgacgcaagagcacatccctatgattgatgaacgatgcggtgatgcggtaggcatcggtgtcctcgtagtcacacggacgaacgccatcgtcatcgaattgaaggatctgcgcccctggcagtccgagcagtatcggcgaatgggtggcgacgatgaactgcgcgccctgttccgccaaccgatgcatatgcgccagaagtgccagctgccggccggcggacaatgcggactcgggctcatccatgagatagaggccgggcgcattgcgtgacagcatgatctcgaggaagccttcgccatgcgacatctcgtgcaatgcagacatcgcgctgcgacctcgatcgtaatcacgcgcctgcgtggccatcgtgaagaagctctcggcgcgcaggaagaaactggatggcggaatcgctcgtttgcggtagagaataagcgcatcggccagatccgaacagtcatcataagtgctgaaacgatagttgcgcgaaccaccctccgcgctgaagccgcataccaccgcgatcgcctccagcagcgtcgatttgtcgctcccgttctctcaggtcagcagcacgacgggtgaaccgaactccagttcgtcgagcgagcgcaatgcgggaatccgattcacatatgaggcaccaagctgtctgtaatcgacacggaatccggagatagtcaaatcatccatcggcacccgtccaatcgcgagctccggcacaataaacggaatatatggcaacagacgcataaaccaccttttcgtggacgcacgcctcccgcacaccacactctaccggcgtggacgaaacagaacactgggcaccacaatgcttcatgtcaggcgtcaatgccgtcgatttgctgttccaatgcgttcatgaacctgtcgacataggtgatcattgcacgacgttctgcgggttcgagtgtaggcatcgcacgcacttcagcctgacgcaacggtgcaatcatgcgctcccggtaacgctccccctcttcggtgaggtggattcgcttgatgcgcttgtcgtgtttgctgccctgcaatcggagtaatccttgtgcgacaagcgaattgaacacattgttcacggtctggcggggcaacaacgtataggcgcaaatctcccgctgtgacgtaccgtcgttctcacggatgtagtcgaaaatgagatacacgctgaacaagagtccggaacgacgcccatacgcgccgtagatcaagtcgacacggcggaactcctcgaagaatgcgatgagctgtgtatcgagatcgctatgggccgcctgcgcgtgctcgatcacatcggcgcggggtgactcgaattctgatgtatgctcagtggacattggacatggaaggggccggccacagaccggccccttcgaccctcagtgctggtcgaggtccagcggcttgacacggcccgaatcgagcaggctctcgagatcggcagggccatcgagcacggccgtggcggcctgatccaccatcagactgatgcgaccgttcggcagaatcccctcgcaataggcgtacaccggcttaccaagcgcatacccgtaggcgagcgcgaagacggcacctgcatcgttgtcgtccatattcgcgatcacggcccgggaattggcgattgcggcgatgcgattggcgaagaccgcctgtgggcccgagacgttgacgtccatggcgaaacgcggacggtacacgctcatgccgcggtcgttgagcaccttctcaaggcgctccatgctctccacctgttccgccgtctcatatggccccgccacatagaagtcgtagacgggcttcgaggacgtgaactgaatggtttcattggaatcgaaattgctcatagccctattgaacctctcttccaccgtgattccggcaagttggctgtaagcaatactactctgggccagtccggcggaccgctcctacaatggttgcgtcagcccggagcatggaatgcctccgggaatgcgggaccgcagaccgccgggcttgcggaaaggaaaaggcagacagcatggattcgaccagacaggctgcagaaacgcggttggagcacgacgtcataggcacaatggagattcccgccgatgtgtactggggcatccacacccaacgagccatgggcaacttcacggtcaccggcatcgccgacggctcccacactgcgctcatccgagcctacgccaccgtcaaacgtgcctgcgccatagcaaactaccaattgggcatgctcgatgctcgcaaggcccatcacatagagcaggcctgtctggagatcgagaacggcgcgcttgccgaccagtttcccgttgacgtgctgcagggcggagcgggcaccagcctgaacatgaacatgaacgaggtgattgccaaccgcgcgcttgagctggccggaaagccccgtggcgactacgggtacattcatcccaacgacgatgtgaaccgcagtcaatccaccaacgacacctatccggcggcctgcaggctcgccatcctccaaggtctcaagcccctgcgcgaggccacgcagcgtcttcgtgaagcattccacatgcaggcagaccgccatagcaacgatatcaagatcggccgcacacaactgcaggatgcggtgcccatgacctacggtcaggagatacacgcttgggcgagcttcctggcgaccgacttggaggccatgaatacgttggcgaaacggctgtgcgtattcaatttgggggccacggcaatcggcactggcatctgtgccgatcttcgcttccgccacaccgccaccaccgtgctcgccgaaatcaccgacctgcccatcaccgccgcctcggatcccgtggccgccgtcaccgacaccagctcctacatcgaagccagtgccgtgctcaagaatcttgcggtgcacctgaagaaggcagccgacgacctccgtctgctcaattccggcccgcgttgcggattcggagatctcacggttcctccgcggcaggcaggctcctcgatcatgcccggcaagatcaatccggtgattcccgagtgtgtggaccaatgctgcttcacgatcttcggcatggatgtgaccgtcaactgggcatgcgcggaaggccagctccaactcaacgccttcgacccgctcatcattcacgagatactcaccgcgatgacgattgccatcaacgccatggacatgttccgcacgaaatgcgtcgacggactgagaatcaacgtcgaacagggacggagagacgcggagatgtcgccatcgatctgtgccgcgctgaatgggaagatcgggtatgagcaggcgatgagcatagccaaggaagccgtcgccaccggcaaatcggtgcgcgaagtggccggggaacgcaccgacgccgatcgcaccgaactcgattcactgctcgacatcgccgccatgtcgcgaaaactcggacagacctgccgtgacgtggatgccgacggcaacgtcatctcaccgacaacggactgaagagcggcctcatacgaggtggggcgagccgcgcgaaagcacgccccacctcttttcacaccgaatactgagcagtccatgaccaatatctgagattattgcctggtttttgcataaaaactcttgactcgcgaaccattccgcgctttcctgaaaccatgagttcaacatcgccatcccactccctcacgttggagacctgccccctcaacaccgacgtggtgatccgagccatcgcgctcgatgagcgccatcggttccgcatgctcgagctgggcttgcgcgacggcgtgactgtacgcgtggtgcagaagtcgaatttcggagggcgagtggtggccaagggcaccgaacgcattgcactcgacgagtccacggcacgcagcatccatgtcaccacaaccaccgcgcagaccgcgcattgagtaccattccatctgcgaaattccacgattcccaaggtttggaccgatatgagcaacgaatcacattcccagcactcacgcggcttcgccgccatactgccccgcaaacacgacgggcatcgcagccgccataccaagccatgctgcgacaccggcggtcaccgcatctcagcgaatggctcgcaccgacgcatcgtgttcattggcaatccgaacgtcggcaaatcctcgctgttcaacgcgattctcggcacaaaaagccgtgtgatgaacgccccgggcactacggtgctgctcgaggaaggcgaatatgcacatgatggcaacacatgggatctcatcgacacaccgggcacctattcccttcttccgctctcccccgatgagaaggtggcggccgacaccgtgatggggttggatggggagaagaatcccgaccttattgtcaccgtgctcgacgccacgaacctctcgcgctcgctgtatttcctcgccatggttctcgaactcggcaagcccaccgtggtcgcattgaccatgaacgacctcgcacgcaaacagggagcgggcatagacccgaaggagctctcacacacactgggaggcgtcccggtgattgaagtgaacggccgttccggtgaaggcaagcgtgagctcatggatatggtcggcactcacttctccggcacgccgctgccggcgggactcaccgccgtcgaccctcatgacatcgacgtgccacaatgggtggagggcaatgccgacgcacgattcgactgggccgcacacgtgctttcacagctcaatatgcaggcacgcgaccgcgtgacagtctccgatcgcatcgatcgcgtgctgctcaacccgttcctgggcgtcatcgtgttcctcgccctcatgtatgcgatgttccaagccaccacggtattggccggccctgcccaggattgggtggacggcactgtgcgcgaatggctcaccgcaggcgtggactgggtgttcaatctattcgggccgcataccgtagacggctggttccactcactcgtcgtcgacgggctcatcgacggcatcgtcacgatcggcacattcattccaccaatgggcatcatgttcatctgcctgtcgttgctcgaagattccggatacctcgcccgcgcggccttcgtgatggacagggcgatgcgctgcatgcatctcgacgggcgcgccttcttgccgatcgtcatcggattcggctgcaatctgccggcgctcgccgcgacccgtacgctacccgattcgcgccaacgcgtgatggtgggcatgcttgtgccgttctcaagctgcaccgcgagactgtcggtgtacatggtgctcgcctatgcattcttccgcgagcaggcgggtcttgtggtgttcctcatgtatgtgatctccattgtgctcattctgctggtgggcatcctgctgcgcaaggtgaagttcacgagcctgacctccgagcctttcgcaatgagtctgccgccataccagtggccgcgtctcgtcgtgctcattcgctcggtgctcatgcgcctgtggggattcgtacgtggcgcgagctcgatcatcatcaccatgctcatcgccatgtggctgctgcagagcattccggcgaccgcgacggccggctcgttcgctgcggtggatgacgtgcatgattcggtgtatggcgttgtggccgacaccgtggcccctgtgttcaagcccgcgggtttcgacgactggcatgcatcggccgccttgatgacaggcttcgtggccaaggaggtcgttgtcgcgtccatggcgcaatcgtacagcatcgacaccggcgatgaggacgagcagcaccagggcgaaggctcgcttggcgcccgtctgcgctcgtcgttcgacgaatcatccggagggcacggcaaggccgcggccattgcgttcctggtgttcacgctcgcgtacacaccatgtctggccacggtggcggagatgagacggcagttcaatatgaagatagcgatgcaatccgtgggcatgagtctgatcatcgcctatgtgctcgccgtgctcgcattccagttgctgaggttcatctggtgagcaccggtttccgtcggacggccgcacacccagctaccgacagcgggcgagcggacggtgtggtagaacgcaccatccgctcgcttgaatcgggtatgtcagtgggcgaggttgcgcgcgcgagcaatctgccacgcgatttcatcgaacagatcgcggtgttcgcacgcgagcgcgggcggcttgacttcgtgtcgctctcggcagactcgggatgcggaaccggttcatgcacgcccgatcccgattcgatcatctgtgcaagctgcccgctcgcgccacctgccgcgaagcgaggccatacgcctctggcccatatcgcgtcaactgtacgcaatgcaatcggccgcaataagcgttcctaggaatgcggttaacaaacgccagccatcgtgaaccgcatgcatattcgccatgcgtttgcatagcgcaggcacatgcgtatagcgatgggctgaacaggcgagaccccgctcccccgcccaggtattactatgaacactatgactgaacacacaacgcacactcccggggactcgccctgggtcaatccgttgcgcgacccacgagatctgaggcttccccgcatcgccgggccatgttcgatcgtgatcttcggcgtcacgggcgatctggctcgcaagaaactgttgccggcgatctacgatctcgcgaaccggggcttgctgccaccgagcttcggtctcaccggtttcgcacggcgtgattggacggaggatcatttccgtcaatttgtcaaggaaaatgtgcagcagcattgccgcacgcatttcaacgaggtcacctggaaccagcttgcagagggcatacgtttcgtgcatggcaccttcgaggatgccgatgcattcgagcgcctgagcaatacggtggccgaactcgacaaggaccgtggcacacgcggcaaccatgccttctacatgtcgattccgccccgtgacttcccgctcgtggcgcagcagctcgccaactgcggtctggccaaatcgaacggcgacgcctggaggcgcgtgatcatcgaaaagccgttcgggcacgatctggccagcgccaaggagctcgaccgcgtgatctccgaggtgttcgacccgaactcggtattccgcatcgaccactacctgggcaaggagaccgtgcagaatctgctggcgttgcgcttcgccaactccatgtacgagccgatatggaattcgaactatgtggaccatgtgcagatcacgatggccgaagacattggcgtggcggggcgagccggttactacgacggcattggtgcggcacgcgatgtgatccagaaccatctgctgcagttgctcgcattgacggccatggaggaaccggtttcgttcaatgcgcgtgatctgaccgatgagaagacgaagattctctcggccgtacgcctgccgaaagaccttgccgcgcataccgctcgcggacagtattcagcaggctggcagggctcccgtccggttgtggggtatctggaggagaagggcatcaacccggattccaccactgaaacctatgcggccgtcagactcgatatcgacacgcgtcgctgggctggcgtcccgttctacctgcgtaccggcaagcgccttggccgccgcgtgaccgaaattgcgctggtgttcaagcgcgccccgcatctgccctttgacagcaccgcgacacaggaactcggcaagaacgccatcgtcattcgcatccagccctatgagggcgtcaccattcgtttcggatccaaggtccccggaggcaccaccatggaggtgcgcgacgtctcgatggacttcagctacggccgttcgttcaccgaatcgtcacccgaggcttacgagcgcctcatcctcgacgtgctgctgggagatccgccgttgttcccgaccacacaggaagtggacctgtcgtggaagatcctcgaccccatcgaggatttctggtccacgctcggccaaccacaaccatatcgtgccggcacatgggggccccaggaggcggtggagatgcttgcccgtgatggacaccgttggaggatgccatgatcctgacattgaccgatacccagaccgatgaaatctcggcaaagatcgacgagctccacgaggagcgcggcgaggccgcactcggccgtgtgctcacgcttgtggtcgcaaccgacgagaaaaacctcgaaagttcactgtgcattgccaacgaggcaagccgcgatcacccatgccgtgtcatcgccatctgcccaagccatagggagatgaccgaacccgagtccgaacgcacctatctcgatgcggaactgcgtgtgggcgcggatgccggcgccggcgaaatcatcattctgcgcccgcgtggcggcctcacccatcacctcgacacgttggtgatcccattgctgctgcctgacaccccgatggtggtgtggtggccgaccgaagcgccggcgaacccgtcacacgacctgctcggacagatggcacacacgcgcatcaccgacgcatatcgttcatcgaacccgcaacgcaccattgaggatctacgccgcaactggtcgtcgaagaacgtcgacctgtcgtggacacggctgacgctgtggcgtgccgtgctcgcctcaatggtggatcagccgccgcatctgccgatccagtcggtgcgcatcaccggcgagcaggactacccgccaatggatctgttggccgcatggctgaccctgcgactcaatgtgccggtcaccatggaaatcgagccaaatgcgcaggcgatcaccggcgtctacctcacccgcaaggacggcgagctgagtctggaacggcgtccgagtgaagagggcattgcgcgcattagcgtacccggccagtcaccacaggccatgccgctgccgatccgttcgatgatcgattgcatgagcgaggaactcggcagactctaccccgatgaaatctatgccgaagtgctcaccaagggctggcagaagattcacccgagcatccgctaacacattccctgccccgcatgctgcccgcttgtttgagcgggcagcatcttgtttaccaccctttcgaagacgaggactcatgaaccgcgaacacatctcctactccaccccccaacttctcgccgatgccgtggcggcacgcacattgctgctggccaatgacattctgtgccgtcccgaccgcgaacgcgtcgacatcgcattgacaggtggcaccgatggcaccgccatcctccgcgccctcgcaggcagtccgctgcttgacgttcccgattggagcaaggtgcatctgtggtggggggacgagcgcttcgtggctgcgaacagcgccgagcgcaatgccgtgggagcatctgacgcgctgctcgacatgctgttggaaacgaaacgcatcgcccgcaaccagattcacgaaatgcctgcagaccgccgttcgcaggaggagctcgcagccgccaccgatcaggacaacgccgtggcgttggcggctgcggcggccgattatcaggacgagctcgaaaaggaactcggtgagaatggccatttggacatcgcgatgttcggcctgggacccgacggtcacttcgcttccctgtttccgaatatgccccaagtcggcatcaacgaccctgatgtgctggtgacgggtgtgacgaattcgccgaagatgcctccattgcgcctgtcattgacggtgccgatgatcgtgaggacggattacgtatgggtgtgcggctcccgtgagggcaaggccgaggcgatgggattgacgttccacgcccagaacaatcctgcccttcccgcctcctatgcggatgctgtgcagcaggtgctttggatcactgacgaggcggccggccgggactgctgatatccgcacggcttgtggtatgggaacggggcggatgcatgttcatgcatccgccccgttcccataccacaagcgaaatcagtcggagatcttgacttcattctgctcaggcgtagcccacaggatgtggtaggcacccggcatatcgacacggccataggtgtgtgcaccgaacagatcacgctggccttgcgtgagcgcggctggaagcctcttggcacgcaggccgtcgaaatacgcgagcgatgacgagaacaccggcgccggcaggccggacttggctgaggtggccacaacgctgcgccaatccgcctcgctgtgctctatgccgctcttgaaatacggggcgaacaacagcgagacatcggcctgcccggattcgaaggcctcggagatgcgatcaaggaactgcgcacgaataatgcagccggcgcgccagatgcgtgccagatgcgccatgtcaatgttccatccataggtccgtgccgcgacgctgatctcattgaagccctgcgcataggcaatgatcttcgaagcatagagtgcgttacggatctgcccgatgaactcctcgcggctcagatcgccgagatcgatatggccgtcgggacctgcaaacggattctgctgtgccatctcgcgcagtacgttctggtcggagagcccgcgtgcgaacacggcctcggcgatgccggtgaccggaacaccgagttcaagggcggtctgcaccgtccaggttccggtgcctttcatgcctgcatggtcgacgatcacatcgaccaacggctttccggtgcgcggatccttcttgtgcagcacctcggcggtgatctcgatgaggtaggagtcgaggtcggtcttgttccagctttcgaacacgccgccgatctcatcgggcgtcatgttcaggccacggcgcatgatgtcgtagctttcggcgatgagctgcatgtcggcgtattcgatgccgttgtgcaccatcttgacgaaatggccggccccgttttcccccacatgcatgacacacggctcgccatccgttgccttggccgcaatcgattcgagaatcggcttgagacgctcccacgactcatcgctgccacccggcatcatcgatggtccaagcaatgcgccttcctcgccgccggagacacccatgcccacgaaatgaagacccttggcgcgcagttccctctcacggcgaatggtgtctttgaaataggcattgccaccgtcgacgatgatgtcgccaggctccatatattcggcaagctcgttgatcaccgcatcggtggccgatcctgccttgaccatgatgatggcggtgcggggacgttcgagcagatcgacgaactccttgacggtcttcgccgggtagaacgcgccctcgtcgccatactcctccatgagcttctcggtacgggaataatgccggttgtagatggccacggcattgccatgacgggccagattacgagccaggctcgcccccatggcagcaagtcccacgacacccacatttgccggtgcactcataaatgtatgcctcctgtattcgattgtgttccgtcaccaagtctagcccacattctgcctaatgcacatgcatcttccctgcactgtgcatgcattcacggcatgcattgcgtagtcggcgaaattgctcgaccaaaggcatcgaggcaattcgagccacatgacctcgaacgaccaatgcctgaccattgaacagcgggacatagtcctgctgcccggcatgcatggcgacgatccgacgtgcgctggagcccatcgacaccgagccgacgtgcggaatgacatggaagcgcgtgagggcgagcccccgcatacgcgtatgccccctgttctcatccatcggcgcgatgtacgagatgtcgtcagacgccaccaccgccccagccgactcccccacatacggcaccccttcgcgcaccagcttgcgaatgacgtcatccgcatcggccgcatgcagatggtgcatcaaatggaatgtgttgccgccacccacatagatgatgtcgctggactgcaatcgcgcacatacttgagcggcgggcatacgttcgggatccaccatctgcacccgcaatccagcgagcgcgaaccgtatgcgcatgagcctgacaagcaccccatacgactccaccgtgctcgccgtcggtatgaatgccatgcggacgccacgcaacgggccgagctcacgtctcagcacaggcatgagccctgtgctcgacgaggccagaaccagcgtgggaccgcatacgtgcgtgttcacattcatatggcgtctcctcgatgtcgctcaagcgccacactagaaccgaacatacggcacaggcacgttttcctctgacagcgtgcacaaatctgtcgcataggcaggcacaataggaaaggacacacacggcacacacggcacacaggagcagacatgggcaaactgaatcctcattcgcataagcgactcgacacacgccaacgcatcatcgtgggcatcacgttcttctcgatgttcttcggtgccggcaatctcatctttcccccctatctcggggctctcgccggcaatcgcacactcgtgggcatggtcggtttcgtcgtctccgcagtgggactgccgatcctcggcgtgatcgtcgtggcgcaggcgggcggattcggcaatctgagcgccagggtgtccaaacgtttcgctctggtgctgggcgtggccatcatgctcacgatcggcccgctgttcgccattccgcgcaccgcttccacctcgttcgaaatggcggtcgttcccttcgccggccaacagaacctgtggctggtgcgtctgctgtattcattggtgttcttcggcttggcgttcctcgtggcccagcatcccgacaagctgtcgcaggtgctcggcaaggtgatgggcccactgctgctcgtcatgatcgtcgtgctgttcgccgcctgcctgttcgccaaacatcccggattcgcgaatccgcagggctcctatgcgcaccatcagctgatgcagggcttcatcgacggctaccagacgatggacctgctcgccggcctctatttcggcattgtcatctccgcgaacatctcctcgatgggcgtcgaagacgagcatgacaatcgcgcggagaccggcatcggaggcatcttcaccggcatcatgctcgccataatatatgcgatgctgggttttgtgggggcggtctccggttcgtaccaggcaatcgatggcgccaccgatacaggcgccaccgtgctgaccaatctcaccgaccgtctgttcggccatgtgggcaccatgtttgtgggactcattttcattgtggcctgcttcaatgtgtgctccggactcctctccacctgttcgtcctacttccataagcagttcggcaccgtgcttggctaccggggttggaccatcgttttcacactcatcgcactggtcattgcaaacattgggctgagcgccatcatcaaactctccgtaccggtgttggaggccctgtaccccatagccatcgtgctcgtactgctctcgctcctgcatggcgtgttcacgcggcatttccctgctgtctatttctggacggtgctgttcaccgccatcgacagcgtggccaatggcatcgccaatctcgtcgccgcattcggcggacggctggtatggctcgagactgcgtgcaattggcttccactcaactcggtggctcttggttgggtcgttccagcgctcgccgggtttgtcgtggggattatcgtgagcattgccgaacgcatgcacacgcactgaaccggaacgggattcctcactcgccggcagaagcgctcagccgcgcgtcgagctctcctaccaaatccccatagccttcctcggccatccgatctcgcggtacgaatcgaagtgacgccgaattcatgcagtaccgcatgccgccacgttcgcgggggccgtctgcgaacacatggcccagatgactgtcggattgcacggcccgcacctcgaggcgcgggtgcagcggcaagctgtaatccttgaccatgcgtaccgacccctgatcgatcggcgtgctgaacgacggccagccacagccggaatcgaatttgtcggtcgagaagaacaacggttcgccgctgactcgatccacatagatgccggggtcgaacagacgatcatattcgttatggaacggcggttcggtggcagactgctgcgtgaccgcatactgttccgggctcaggctccagatgcgttcgatatgacgctgacgttcgcgcatgtggtcgatcacgctcagtggaatatgacagtagcctgttggattggcgagcaggtaatcctgatgttcgggctccgcaatcgtgaaattgcgcaaatcctcgatctcaacggccggagtcgatccggagcgttgcgcgagttcgtccaacgcctgctcatacaccgcgcgctgctcggcggcatgcgcaccggccggatacagtccggaacggtattgcgacccgacgtcgttgccctgacggtcgacgctgaatggatcgatgatgctcaggaacagcaaggtcagtgttcgcagactcacccgcgtcggattgtaatcgatgcgcaccgtttccacggcgtgggtcgttcccgaacacaccatgcgataggtgggatccggcgtaatggattgcgcgtatcccaccgtggtgtcaaggacgccatcgacattctgcatggctcgttcgagtccccagaagcatccgccggccatataggccacatgcgtctcgggggcggccgcctccgtccgttgcattgtcatctcactgcccgacttcgtatttcgccggatcctcgtcgaagacacctgcgcaatgcttgctgcagaagtagattgtccgcccgtcatagacgcgggtgtcggcggcgtccttcggatcgacgaccatgccgcagattgggtcgatgtgttcctgatgtgccatggtatgctccttatgttcatgttccgtgatggattcatgccggcagtcggtgtgcgtgccgcaggactggagagtctgcgacggcaacgcgaaacgaagattcaacggcgtgcgcgcacctctgcgtacaggcttagcatggttcggcacgaaggcgtgcagtctgtttgcgttgagcacaacggacaacgaggagaatgccattgcggcacctgcgatcatcggactgagcagcacatgccacagtgggtagagcacaccggcggcgaccgggatgcccagtccgttgtagccaagcgcaaaacccaggttctggtggatgttgcgcatcgtgcgatccgacagatcgatggcggtgaccaccgactcgagcgacgaattcatcaacgtcacatccgcggattccaccgccacatcggtgcccgaacccatcgccatgccgacatcggccctggccagcgctggcgcgtcattgatgccgtcgcccaccatggccaccacgcggtgctggttctgcagttcgcgtacaacggcctccttatcggcaggcgtgacctgtgcgacggcatgggtgatgccgagctcccgggcgattgcctgtgccgtggcctcatggtcgccggtgagcatcacgacgtcgatgccccgcatctgcaatgcttcgattgcctgggccgaggtctccttgagcgcatcggcgacggcgacgaccgcgatcacgacgccatccacggcagcgacgaccggcgtgcgtgctttctcggccatctgttcgacggcgtcatgcacccgcttcgaaacagctgcatcttcatcaacatgcgcctgcacgaagcgttcattgcctacgaccacgcggtggccttcgacatggccgctcacaccgccaccgggctcgttatgaaaatcgcgcacctgtggcaacgccccatgcggggcttgcacctcggagcgatatgcctgcacaatcgcctcggcaagcggatgctcggatttcgcctctactgcggcgacatacgagaatcccggtatcttagccatatgggagacgtcgatcggaccgccgtcatcatcggccaggcccaccacgtcgacgacctgcggcttgcccacggtgatcgtaccggtcttgtcgagcaccacggtgtcgatgcgatgcgtgttctcgagcgcctgcgccgaacggaacaacacaccatattgtgcacccttccccgtggcgatggtgatgctcaatggggtcgccagtccaagcgcgcacgggcaggcgatgacgagcacactgatcgcacagacaatgccgtagagcacatgcaatggcatcggagccatctgccagaagacgaaggtccagacggcgatgatcatgacgaccggcacgaacacgccggccacccggtccgcaatgcgctggatgggcgccttcgaggtctgcgcgttacgcacgagccgaatgatctgtgcgagcacggtctgggatcccacacgggtggcacggtagcggatcgtgccattgccgttgaccgtcgaaccgaccacgctggctccttcccccaccgccaccggcatcgactcgcctgtcaccatcgactcgtcgatgcttgtgtggccgctcacaacaatgccgtcgatcggcaggctctcgccggggcgcacctcgatgatgtcgcccaccgcaacgtcggcagtggggatatcccgcataccatgctccgtgacgacatgcgccgtgttcacccgaagtcctaccaacgccttgatcgccgcaccggtgccggcctgcgccttcgcttcgaacagctgtccgaggatcatcagcgtgatgatcgtcgccaccgcctcgtaatagggttcgcgtgaccccacgggcagcgcgtctggccagatcgtgacgaacagtgagtacaggaaggccacgcaggtgcccgtggtgaccagtgagttcatctccggtgcgcggtgggcaatggcgagccaaccggtacgatggacgggccaaccgcaatagaacatcaccggtgccgtgagtatgagctgcagccacgggctcatcacccatgcgggcaacgtatgcgccatccatgcccccacagcggggatcatgggcagcatggcgatgagcagttcaggcaccgtgaacgcgataccgacgatcagtcttctcttgagctcgccgatctcatgctcccgctcggcgtcgtccgccgactgcagctgttcgagctgctccgcatcggagagtcccgtggcctccgacacgccattggattcggctgctgcggtttccccgttgcctttaccggtcacccgcagcatcccatggagcatgttcatgccacaggcgaacgggtattccccgggtgcgagggcgggcagcctcacctccgtatgggcgaacgcctgcagggtgcggtctatgccgagctccgggaacacgacgtgggaggagcattccccgctctctttcctatcgaagtcgagtacgatcggcgtcccggccttgacctcaatgagcgacggctcgtagcctccgcggacgacgacatgcgcggtctgcataccctgtgagacctgcgccttgtgggctttcctaggggcgaagaagaaccatacgatgaacgcggtgagtgccacggcaactagaatcgaccaaaccaacgtcatgttgcacctcccactggatgaatgcctgcgttacgacaacgtgggcgcgtccacacatattcccgccgcgctccacgcgtggcggaaatgcatgccatgggcaacccgcgtgattagtgtggggcatatcgatgcgcatgtcaatacccacgcatcagaacattgcatgaatcgaggcattatgaccactttgatcaccggtgcgacaggcggcttggggcgcgaactggcgctgctgttcgccaacgacgatcacgatctcctgctcactgctcggcatgcggaccagcttgccgagctgcaggcgaagttgatcaagcagttccatgtgcacgtcacgtcggtggtgctcgatctttccgacaccgaggccgccgagaaactgttccgctatgcccaggagaaaggcatcgtgatcgatacgctcgtcaattgcgcaggcttcggggattgggcggacttcatgcatgaggacaggcggaaactcaatgcgatgatgcaggtgaacatggttacgctggccaagctcatgcgtctgttcggcgaggacatggtgggccgtcacggcgggcggattctcaacatcgcctcggtcgcggcgacgattccggggccgtatatggccgcatattacgcctcgaaggccttcgtgcgctcactgagtgtggccgtggcccgcgaggtgcgcggcaccggcgtcaccgtcacatgcatctgccccggatccatcagcaccggattcgaaaaggccgctgccatgcaggggcacaatttcttcacgatggtcaggccctccacgccaaaggccattgcccagttcgcgtaccgcaagatgcaactcggccgtgcgctgggctatgcgggagcctttgcaaagggcgtcgccttcgccacccgcctcgcccccgaatacctcaatgcgctctgcgcaggcttcatgaacggcggagatccctcggctacaacttcatccgagaacccccagaaataattcttacaatcaatcaggtgaggtgtttggggtggggctggcaggcacatttcgtcactgtcgcaagctcccttacgttcctcgatgtgcctgccagccccaccccaaacaccggcaatacagcctgaacatgcgagatggcactccctttggccgtgagggtgggcataggctgaggaacgtaagggagcttgcgacagtgacgatgcctatgcccaccctcacggccaaagggcgaacccgtacacacgttcagcgacggccacggcccccgcggaacggattgttgttgcggcgcttgcccttgttcttgaactgcccatgcttgcctgatttctgggcgcgcttgggggtggttcgactctgctcgcgggcctcgagcctgcgttcatggcgcttgaccgattcatcgcgggcatcgaacagacggccgttgtcgtggtggtggatgcgtttgccaccccgacgctcttcacgctcctcctcgcgacgggcacgacgccgttcgatgcgtttcttgccgttgttgcggttctggcgtgatttcttgtaatcgcggtcgtcaccggcctcgccgaactgctcggcgcgacgttcctgccggttgcacggccgttcgtcgcgccgatgattgcgctcatggcggctcgcctgttccgactccgcaggctcggagtaacgtgggttgtccgaactcacatcgccgaggaacaatgcggcgaattcctgctgctccttggcaatccggcgttcgcgttcggtgggcctatgctcgcccttgccggtacggcgtccaccacgggccgagcggttgccccgttcctcatcacggttcgtgcgaccccggtcacgacgcgacttgccgccattgcctttacgaggtctgcgctcaagctcgggaagctcccagccatgcaccggatcggctttctgccccacgagttcctgcacctgtggggattcgggggtgacttcgactggtttgagcttgatgtcgacctctttgaacaggtgacgaatcttgcgcttctgatccggcgtcatgagtgtgactacatcgccggactggccggcacgtgcggttctgccggaacgatgggtgaacgacttgggatcctccggcggctcgacctgcaccaccagaccaacgttgctcacatcgatgccgcgggcagccacatcggtggccacgagcacgttcacctgaccggattcgaagacctgcaggttccgatcgcgttggtgctgactcaggttcccatggagttcggctgccgggattccgctctgcgtcagtgtatgggcgagcttcttcgcctggaacttcgtacgcgtgaacaggatgcggcgcccacgtccactggcgagctccctcacgacggcagccttgtcgttgcgggagacgaggaacagatgatgggtcatcgaatcgacgttcgacgtcacctcgtcgacgctatgcaccttcggatcatgcaggaattcactgaccacctcgtccacgccatgatcgagcgtggccgagaacagcatatgctgcgcatcctgtcgaatctgcttgagaatgcgtttgatcggcggaagaaaacccatgtcggccatctcatcggcctcgtcgagcaccacgatgcgcacatcggcgagtgtcagcgcctgctgctcgatcaggtcctccagacgtcccgggcaggcaacgacgatgtcggcgcctgcgtcgagagcacggaactggcgttcatacttgacaccgccatacaccgtagtgacagccatgccataggcatctgcgagaggagtgagcacgtcactgatctggttggcgagctcacgggtcggcgccagcaccaggccgcgcggatgcggcatgtacttcgagacaccgcgcttgaaacgcagcgattttcgcaacgtctgcgaatccatgtcgcgggggaaatcctgatcgtcggcgcgatccatgctggagagtctggagacaagtggcaggccgaaagccagggtcttgccggaaccggtctgtcctcggccgagcacatcacgcccggcaagcgaatccggaagcgtgtcctgctgaatggggaacgcggtctttttgccgtcggcggccagcaggcgaacaagtagcccgggcacgccgagttcaccgaacgactgcgcgggctcctcatatacagagtctgcatcattcatagtggtatctaaatcattcaacgatggtgtaagtggcacgatggcctttcaggtcgtaatacgatgcgcgagtgcgcaaactcacccagtttagcggacggccacaaccaaatgggcccaccggacacgccacgggagctgaatggccggcgtttcagtatgacttccacggcaattgctcaaataaatgaaatactcgtctcatgcatggagcaactgtattatgaaaaccatgaaagaattctgtagaaaatgggccaaacgcattgccacgaaacagatggcgctgattgccatcatcacattgacggccacactcatcggcatgtgggccgcgcggttcgagggtctcaagatcctcggcgcgctcattatcgccctgctcatcggcatggtggttcagttcccgattcgtgcctggtacaccaaggatgatccgcaacgtgcggcaggggtgaaggacgcagctggtctcatcgccaacaagttcctccgtttcggcatcatcctgcttgggttcaagctcaatctcgaactgcttttcaccaccggcgcgaagtgtctgccccttgccgcgctcgtcgtgaccgtcaccgtgttcgtcacctactggatctgccgttggatgggcgtcgacccgctcatggccatactggtctcctgcggcaccggcatctgcggagctgcggcggtcatgggcgtctccggctccatcaaggtctccccgaaacgtgagagcgagaaggagaacgacgaagtcaccgcaatcgcaatcgtcgccattatgggcaccatcttcgcattgctcgaaatcgccattctgccgctgctcaacctcacccagccccaggagggcttcattgcaggtggctcactccacgaaatcgcccatgccgtcgcagccggcgaaggcctcaaccgtccggttcccgccggtcaggtcgatgcggccaccatggcgaacatcatgaagctttcccgcgtgctcatgctcgtgttcgtctcgatcatcgtggccatctggtgggataagcgccatagcgaggtcaccgaggtgggtggcaagcgcaaggtcgcattcccctggttcatgctcggattcatcgccacggcagccatcggcacgctgttcctgcagacggttcccgccagcgccggtttcatcaacgcactcggcggcaatgtggcgaagatcttcctcggcatggccatggcctccctcggcatcaacgtgaacttcaaggcgattgcgaagaccggcgtcaagccactcatcgccagcttcatcgcctcgatcatcctggtgctcatctgctggggtctggcggtgctgttcttctgacaccaccggtatttcgaaacctatgtgtacccatgtgaaaagggccttgggactatcctaaggcccttttcacatgccgtcacctgctgcttcacacatgtcacacagtggtttcccgctgccgctacaatgtattcggccggtggcataacgcctatggccgcattttccaaagctcaagtgacctcagagagaaacggcgaggaaatcgtgacatcattgaagcaaatgttcacatggacgctccatggaaacggaaaaacactcaagcccggcgagatcgtcgaaccgaaggagcgcctcacctggcctcgcaccatcggcatcggcgcacagcacgtggtggccatgttcggagccacattcctggtcccaatcctcacgggcttcgacccgtcgaccacactgttcttcacggcgttctccacggcgcttttcctgctcatcaacaagaacctgctgccgtcgtatctgggttccagcttcggcttcatcgccccgatcgcagccgtggcaagttccggcaaaggcattgccgtcgcgtccttcggcattctgtgcacgggcctgctgctcgcgatcataggcttcgtcgtccagtgggcgggcgccatctggatcgaccgaatcatgccccctgtggtcaatggtgccatcgtggccatcatcggcttcaatctggccccgaatgtctggaccaatttcaaggccgcccctgacaccgcattggtcacccttgcagccgtgctgctcatcgccgtgctattcaaggggctcatcggccgactcaacatcctcctcggcgtgctcgtaggctacgcctacgcatgcattcgcggacaggtcgatttccaggccatcgaacaggccgcctgggtcggcttcccgaagttccacctgcctcaggccgacttcacgatcctgccgatgttcctgcctgtcgtgctcgtgctcatcgccgagaacgtcggccatgtgaagtccgttgcccagatgaccggccataactatgacgaccagatcggcaccgccctcatcgccgatggcctgggtacgacagtcgcgggcatcggtggcggttcgggcaccaccacttacggcgagaacatcggcgtcatggccgccaccaaggtgtactccacggccgcctactggtgcgccgcgggatttgccttcctgctttcgctgtgcccgaagttcggtcaggtggtcaattcgatcccggtaggcgtactcggcggcgtcacctgcctgctctacggcatgatcggcatgatcggcgtgcagatctgggtggacaacaaggtcgacttcgccaaaccgatcaacatcatgacggcctcggtcgtcatgatcgtcggcatcgcgaacttcgagttcaatgtgaacggcatccagttcaacggcatcgccatcggctccatcatcgtgctcgtgctctaccatggcatgaaggccatcggccgcgccaccggcaccatcgtcaaggaggcgccggagcccacaccacaggaacgcaagttcgagaacctcgacgaaccaatagatccgacgcgctaacacgctgattcatcgattgacaacaagccgggtgagcctgtacgccacccggctttcccatatccggccccatccatctcccgcaacgatatagacaagacatcgtcatactgttgttccaaacagtatggaggctttatggagctgtacaggaacaatgagatcccacccatcgaatacacgccaggcaccagcgaatttcgcgacgcagtgatcggtctggcccgttactggacggcgattgcggaggatctgcatgccgacgaaccgggcgtacaggagcgcacggcagccgcctgcctcagattccgcaaggaatgcgcgatgttcgactatgcacgcgcattgcaatggcacgatccgcaaggtgtgtatgtgcacaccgacatcccctacctgccggacggcggctaccgggacggcgaagtgcgcggccatctgctcgacgtctacatcccacgcgatgccatagttcgcggcggcaacacattgccggtgtacatagacatccacggcggcgggttcacctatgggtacaaggagctcaaccgcaatttcaacacgcatctcgccgatctcgggttcggcgtgttctcgctgaactacagaccggctccgcagaccgatctcgtcggccaattgcacgacatccaggcggcgctgtgctggatcggcgagcatatcacacagttccccgtcagtccggacaacatcttcatcaccggcgattcggccggtgcatgcctgagtctgctcaccttgctcatcgagcacaacgacgatgccgcccacgcattcggcatcgaacgggcgtcgggaatccacctgcgcggagcttcgctcatctcgggagtctatgacatcacgccgagttcgccaatgcgcgcgcgacttgccgaaacagtgggaaacgagttcttcgcaggacttgacgatgccaccgtgttcctggatcccgcggattggctcacacagggcatcggcatcccacccctgttcctggtgacgagcagcgacgactttgtgcagtcggagacgctggccttggcgacgtccctcgcccgcaatggccgtgatttcgaactccatgatttcaaggtgccatgcacgcagacactcggccatgtgttccccgtcggcatgacctggcttccggaaagcgaacgtgtgctacacggcatacgggaattctcctaccctttgacacgatagattgttcaccctaaaagatacgaaattaaccctgttttttttgtagaaagtagccttctctgtacgttgcctgcatgaattgtcatggaatgggcagcatgcatgcatacggcttgcataaatgatttctatgatgagagcaacagcaaaagaaaggtcaacaccatgactaccacaacgaacaatatggattcgaacaacatgaacaacggcacggctaacggaggttccacgccgggcgcctccagcgacggcgacctcgacttccagggcaaggccgacgcagccgagaagggcgagaagggatgcggctgcaactgcagcgcgaagcagaccgagagccgcgaacagccgaaatcgaacgaggttcgccagcctgcagagccgagcaatccgttcccgcagtccgaagcccccagcggtgacggcacgggtatcaaggccggcggcgggcaggccgagtgattccgctcccctatcgcaacatcttgcgattctggatgcaaattcaagctccgctccgatacgcggggcttttttatgccctcagcggcggtcgatgcacaattcggcgcgccttggctaggctatacgttcaggatgtttggtaaccaaggaggtcatatgcaaatggacgaaccggggatgcagatgctcgacggcgtggcggatatggtgagcatccagcccgaggcgacggtctcgcgcaccgcgatgagaaccgaaggcggcaacgtcgtgctattcgccttcgattcggggcaggaactgagcgaacacacggccgccatgccggcgttcatacaggtgctccgtggacgcctgctcgtcaacggcggcgacgacgaacgcgaggtggcccccggcgacctcgtctatttgccgacccgactgccgcacgcggtgaaggcacttgagccttcggtgatgatgctcacgatgatcactgctgcacgcgcagccgatgccatcgacggatgagccgagggtgaaggagcacaatgccgcatggccctcccgggtcatgcggcattgacgtcttcggccaaggccctcggccatatgccgatcatttactcacattgaacttgaactcgacgatgtcgccgtcctgcatcacatagtccttgccttcgaggcgcagtttgccctcttccttgattttcgccatcgaaccgtaggcctctacgaaatcgtcgtatgagaccacctcggccttgatgaatcccttctcgaaatcggtgtggatgacgccggccgcctgtggagcggtccaacccttgtggatctgccaggcgcgcacctccttctcccctgcggtgaggaaggtctgcaggccgagaatgtcgaagcccacgcgagcgagctggtcgagcccggactcgtccagtcccgcatcctcgagcatctcgcgagcatccgcctcatcgagttcggtgagttcggattcgaactgcgcattgaggaagatcgccggggcgggtgccaccgacttcgccagacgctgcttgagttcctcgttctgcagctccgaatcgtccacattgaacacgtagatgaacggtttggcggtgagcaggtgcaggtcgtacacctcttccttcttgatctcgccggcctgcgcagcctgatcgatggtgcgaccggattcgaggatctcctttgccttgagcacggcatccatgtagcttttctcgatcttcttgccgcgcaggtccttctcgagcttcggcagcgcgttgtcgatcgtctgcagatcggcgagaatgagctctgtgttgatcgtgtcgatgtcatcgtcgggatcgacatggccgttcacatggatgatgtcgtcgtcttcgaacgctcgcacgacctcgcagattgcatccgcctcgcgaatgttcgcgaggaacttgttgcccagtccctcgccttcgctcgcgcccttgacgatgccggcgatgtcgacgaaggtgacggttgccggcacgatcttgtcggtgtgcacaagctcggccagtaccggcagccgtttgtcgggcagtggcacgatgccggtgttcggttcgatcgtggcgaatgggtaattctccgcaagcacgttgttgcgggtgagcgcgttgaacatggtggacttgcccacattgggcaggccgacaattccgatagtaagagacatagtgcctacactagcggtctgccaagtcatttcaccggttttgcacatctacgcgaaacgccggtgcggcagcgtggaccacgctccctcaccggcgtcacggcattcgttcggaatacagacgagaacgattcagccctgctcgatggcatcgaccgcactgataaccgcaccacggaacgcacggttctcgagttcggcgacacccttgatggtggtgccgccaggcgaacacaccgcatctttcatggcacccgggtgaactcccgagtcgaggcacagggcaccgacaccttcaatcatcttcgcggccaaacgatatgcggtcgcacgctgcagaccgtacttgacgccggcgtcgccgagcgcctccaagtacatgtcggtgaacgccggggcacaaccggcgatgcacatcgcaatccccatatgcgcggtatcgacctcctcgatgagcgatatacgggagaacaggtcgacgaatccctggcattggctcggggtgagggtgttcacgttctcacagatcagcaccccctgggccacggccatcggagtgttcggaatcgtgcactggatgtggatgccggtggccgccccaccgaacagggtctggtatctcgccagatcccagcctgcggcaagcgatacgagcatcttcgaatcgtcggcgagtgctccggccattggagcaagtacatcctcgacctgatatggtttgattgccacgaccaccatgtcggcggccgcgacgacctcctgcggggtgtgcatggcagtgccgcccactgccgcgatgttgcgttccaacttgtcgaaatgcgcggcgcatgccacaatgtcgttcccgtcgaccgcatgcgcacgggtcaatccctgtgcgattgcctgtgccatgttgccgtagccaatgaaaccaaccttcataccactctcctgacagtgtccgatatgccaatactgtatacgacctgcggaaaaacccgatgctagaacagttcgtgcaggtcgccgcggtcgcgtgcctcgtcgaagagatgacggaagacgatgccaccgtgcacgccatcgtgttcgaactcgttcgtcacccaataatgcgagtttcctatgcgcgaaagtgtgtcgagctgcagaccgctgtcgacatacaggtcgtcgaaatacaccgcactgttgagcggcactgtgttcgcggcgagttggttcacgttgtagatcaccccgaaatgcgtgtcctgcatcagcacgtccattgcggcgcggaagggtctgagcgcgcgctcctgctcgaacatccacgggaaaatcgcctcgccggtgaacagcaacgggcgcgcgtcagtgctgaactgcggcagactcccatacacgtggtccgccgcccaatcaatgggggcgtcgaggtcgccgtccgcgtagatgaactcctggagcggccaatacagcggattggaataggtcgcggtcatcgcatcgaacaggaactcgtcggcgagcggggaatccgagtttgccgaaccgtcgccgtcgagaaatgcctcgtcgaagagccaatgtacccgttcgaatgccggtttcatcccgaaactcgagccgagggtctgcagacgctccactgtgaacgggtcgccgttgggcagcgtcacatcggtgctgcgcagaatgtcggccacgcagcccacgcgtttcgtgtcgagcgggtagcgtgcgtagaactgttcggtcttcgtctgcatgcgtgggaaggtgtgctcgtacacctccctcgcgctcgccggcacatggggtatgccaccggtggtgaaactggcgatgaggctttgggggaacagcgaaaggtatgtcagcgtcaggaatccgccgtagctctgcccgagcgtcacccagcgctccccatcgaactcggtgcgccgcaggtgctcgaagtcgcgcacaatggggccggcgaggaatttcttcagatactccgcagcctgccgtccgtccatattcgccacggtgtgtgagtcgatatgcgaggaacgcccggtgccgcgttgatcgggcagcaccacacggaaatgcttgatggcctcggcaacccagccatcggagtcgggcgagagcgggcggggagccgcgccgccgggacccccttgcaggaacaccagcaacggcaaccggtcgttcacatgctccggggcacagaccacgcggtagaacaggcgaatcgtctctccatcgaatcccatgcctggctcatggccatcccagtcgagtggcacgtcgatcgcatactcagacacatggagtcccggaacatagtattcattgagcagtgccatcatactccctcacggcatttgaacgatgcaatgccttcaatctcacccacatgcaccgacaaggaggcacaatcatcccacagacccatgtgcaggtggtctgtggcctatatgctgaagatatgggagaacgcttgaaagccttcttggcgacacaccgcatgctggtcatcgacaccatggccaccatgctgatctgcctgctgtgggccatcaccacgatcccgccatttctggaggatggcctgctgttgcgctgggatgccgacgggtggacgcgcatctggtcgattctgctcacgttgcccttcgcattgcgccgcacgaagccgcatgccgccgccatctggttcgtcgtcacggtggcggtgcagctggtgttcgggccggcattcctctttgcggatgccatggcgttgcccatgttctattcggcggtggtctatgattgccggaaccggacccgcgaatacgccatcatggcgttggccttcgatgtcgccaccgtcgccgtgatcgtattcgcgaacacccatggcacaatcttcgggcgcaatcacatggcgatcctgtcaggggtctatgcctgtgcgcccgagggggccggattctcgatgcagtcatgtgcagccgccagcatggaatcgagcctcctctacttcatcatgttcacgctggtactggccaccacgctcgtggccgcactatggcaacgggcgcgccaacacacgatccgcatgttgggcgagcggaatgcggccatagccgcccgggagcaggaggagaaactcatcgccgcctcggccgaacgtgcgcgcatcgcccgtgacatgcacgacatcgtggcccataccctttcgatcatcatcatccaatccgacggtgggcggtatgccgccacccatgatgtgcaactggcacggtcgacgatggacaccattcggcacgaggccgaacatgcgatgcacgatatgaagcagctgctcggtgtattcgggggctcgtcgcatgccgactaccacgatatcaatgccttgatcgagcaggcggccaaggtctcccccgacatccacgtgcgacgtgagctcgtgggtgagccctcaccgcagctattgagcgagtcggcgagtgtggccatgtaccacgtggtgcaggaggcattgacgaacgtacgcaaatacgcggggctcaatgtgaacgtcgaagtgcgtgaggagtggaacagcggaaccctttccttcaccatcagcgacgacggacgtggtgcctcggcggccatggatgggcataaggccggctacggtctgcttggcatgaacgaacgcatcgaagccgtcggcggcatggtggaggcaggcccccgtctcaacggcggtttcgcagtgcatgctgaggtcccattggccacctccgtgcagcaggccggcatcggctcggaatcgctcctgcaggcaagtgcgatgcacacagcaatgcacggcggctcctccgccgtggaagtctcggaggaaagctgggacggtgatgcggccaacagtaccggagcagacgtggatgacagggatgctcagcagggcaacgacaagggcgaccacgagatttggcccaatttcatgcaactgggcgagtcgttgcgttccaaacccatcgcgcagatacacgaggacggacacgagaactggattaccagactgtcacattgggccgagcaccattatgtgctcaccgacacgattctcgtcgctgtgacgaccgccatcatcgtgacggttcctggcggcatggagctgcaggtcgccggctaccacttctcctcggcatccggcgcctttggggtgatgatgaccgtactgcttatgctgccactgtgctggcgcaggcgtttccctcgtgcggtcgcattggcgttcgccattctcgtgttcctgcaactggttttcgtgagaccattgttcaccgccgatttggcggcgccattcatcgcctatgccgccatgctctacagcagcaaacggggcacctggaaatggctcagcgcactgattgcactcgatgggctgctgtttgcgttcaagacgatgctgcttgtcgagggccacacctcggtcgtcgagtggatgcttcatgccacgcctgcattgcgacccgaagatggcaccgtcagcatcgagttcgccagtcaagtgttcatcgaattcgccgtattgtccatcatggtgtgcctgctggcgatggcgctcggcgcatgggtcaagatcagcggatcgaatccgcaggtgctggaagcccgggccgaggcgctgcgcgaagagcagcgcaaacaacgtatctccgccgccaaccgtgaacgcgaccgcatcagcgcgagcatccaatccgaggtgagtgaaacgctcaacagcgtgattgtcgagacaacgcaggaaatatcgatcatcgaccatcagcttgcgcagggagaggagccgtctgcagaatggatcagtcaggcgttcgcggccatcggcagtcagggacgcaccgctttgaagcgcatgcgcgaactgcttggtgtgctgagggaaaccggtgccagcgatgagacgaatccttcgcagaatcagctcaatctgacgcccgcgaaatcgcttgacgagcagatctccgccgcgcagagccgtggtgtgggcaatgcctagaattcaccgcgttcccgcagtccacagcaggtatgcatatgttccacacatgtctggaatctgcatgaaggcatgcgtttcgctagagtggaagcatggcagacgcaagcaggattcgtatggtcatcgcagatgatcaggaactcgtccgtgccgggttcaccatggtgatcaactcgcagcccgacatgcaagtcgtcgggcaggcctccgacggcacgcaggcggtgcagctcgtcgaacggctccaccccgacattgtgctcatggacgtgcgtatgccgagtatggacggattggcggccactgcgcagatcacgtcacatgccgatggcgagcagcacacccgtgtgatcattctcaccacctttgatctcgacgagtacgtcatgtcggcaatcaacgcaggtgcttccggcttcctgctcaaagacaccgaacccgagacgctgctcaactcgatccgcaccgtgcaccaaggcaatgccatcatcgcaccgaccgccacaaaacggctcatcgaaaagatgatggagacgggcgtcacccaggaagggcccggcagacagcagtcagaagtcgccgccgaatacacggatccggagcttgccaccctcaccgaacgcgaacgcgaggtgctcattgagatcgcccatggactgtcgaaccaggagatcgccgacaagctgttcatctcactgcccaccgtgaaaacgcatgtggcgcatattctgcagaagatcaacgcccgcgaccgcgtgcaggcggtggtcttcgcctatgagaaccacctggtgtagtccgtaccgttcaggcatatgcgaaagccggccagttggagactactggccggctttgccgtgatgtcaggtataaactccatacccgacatcaggtatttgatatccttccaaatcaggcttcggcgagcgcctccaccggcggcgtcttcactgcacggcgtgcggggaacacgctggcgatgagcgagcagacgatggcgatggccaggatgatcgcgtaggttccccagtcgatcacgtagacgacgtcggcaatcgaactcatcacgatgtagatgccgagccagccgaacagcgtgccgacgaccatgcccaccacgctcgtgaccagcgagatcagcagggcctcgattgcaagggaggcgcggagctggccgcgtgtcatgccgatggcgcgcagcgtggccgattccctggtgcgttcgatcaccgacaggctcagcgtgttcgccacgccgatgacggcgatgaccacggccactgcgagcaatgcgacgagcagcatgagcatcatgttgaccatgctctcccactggttgcgttccgccaccgggcctccgactgaaacgttcgggtagacttcaaggtcttgctcgatggtctcgaacacatccgagagcgacatgtcagacggcacattgagcttgatgagcatagcattgccgtccgccttgaacgtgccgtcgtcgaacagcgccgtgttcacgaaggcgaccgcctcgttgttctgtgcgctgcgcttgtagtcgcgctgttccacatgcagatcgaccgggtgctgcgacggattgccttcggcatcggtttggctcagacgcaccgtgttgttggcgaaggtgaacgatgctccggttgcgttgttgacgagcggcatgatcgcatcaccggccccgaatgcaggcgcgggattgtcgatcgagatgttgagcaccgactgcaatgccgcgatgtcgggcacgccaatgaccgtcgtgggcaccgcatgcccctgctcgtcggtgaattccgcgctcgcggtcttcgcatacagcagtgagccgactccccgttcgcttctcaccttgttcgcggcgtgctgcgggatattcgggccataggccacgacgtcgacactgtagcgggtgtcgagtgcctgattcatcgtcgctttcgcggcggcggcaccggtggccaacgtggagatgagcgtgacgcctatgagcagtgccgttcccgtggcggcaatgcgtcgcgggttcttctggatgttggcattggcgagcttggcggccggcccgaacatcgagacgaacgctcccacgcccttcatgagccaaggcaaccagaacagcgccgtcatggccagtccgatgaatgtgagcatgcagccgccgacaccggcgagcaatgcgctggcggagatatcgccatccttgctgtggttcatcgggatggcgatcaaggcgagcgcgacgccgagggccaggaacaggcagccgaagacggcgcgacccacacgggcccgatgctggttggagatctcaagcggtctcatggcttccaacggggtcacgctggtggcggtgcgtgcggcgctcacagatgcgagtaccgtcattgcaacaccgaagagcacgggcaatgcgatgacctgccagctcatattcagcgtcagtcgcatgccgccgagagactggtcccgtgtggcaatggaggccaatgccatgaggccggttcccacgcccacgccgagtatcgaggacacgagtccgagcatacccgcctcctcaagcaccgacacgtagagctggcgcttggtggcaccgatggtgcgcagcaatgccagcgtacggcggcgctgcgccacgagcacctggaacgtgttcgcgatgacaagcgcggcgaccaccagagcgagcacaccgaaggcgagcaggaactgcttggtcacgtcaccaccgttggagctgagggatttgatggcctgctcttccatatgcgcgcgatcctgcagcgtcagccccggcgaaagcgcggccttcacctgcgcgaccacggtggattcatgtgccggctcgatgtgcaggtacgcagcggtcgctggtatcgcatcgaaggaggcgacatccgaataggcgaccatgaggtcgttcgaggcgacggaggcaccgttgtaatagccatacacgttgttcggatcggtggtgagacccgtgatcgtcgcctgcacgtcctgcgcatcgtcgccatgttgcgcatgcgacgagatggtgtctcccaccttgaggttccactgctcggcaagcttcctcggtattgcaatctgccgggcaccatccggttcgggggcgttgccctctacgatcgaaaccgggagcagcttggggtcggcactcgtcgacaacgccaccccgctgccgtgctgggagccggtattcagtatgacactgcgcgtgacatcggcacggacgccttccactcccccgatgcccgctatggtattgagcttaagaccaccaaccgttgagtcgtgtgcatcgtcgccggattgcgcatccgccgtgaccgcatagttcgagccgccgaactggccggtggtctgttcgcgcaatgaggcgtcgaaggcgttcgtgaacagcagcgtcgcggcaatgaacgccgtgccgatgagaatggcgatacccgcgggaatcagcattctcaggttcttcttcatcatcttcatcgtgattgacaacatggtattccttcggattcaggatcgtctgtgctcttggcctgcattagcgacgctgctgcggcggcttcggagcctgcatgagggttccctgtgccggctggccgccgatgtccgccggattgttccggggctgccgcgcaatgggtggattctggtttgccggcatcgtctgaactgcggagcgcccggcggtcttcgtggaacgttcgcgctccttcatgagcagatcactcatctgcgccggttgcgggtcggagacgtcggcgatgatgtgtccgtcggagaatacgatggcacggtctgcataggaggcggccaccggatcatgcgtgaccatgatgatcgtctgccccaattcccgtaccgaggccttgaggaagccaagcacctcggcgcttgaagcggagtcgagggcaccggtgggttcgtctgcgaacacgagcgacggcctggtgatgagggcgcgtgcgatggccacacgctgctgctgacctccagacaattcgttcggacggtggcccagacgttcacgcagtccaagtgtgtccaccagacggtcgaaccatgcacggtccaccttcttgcccgccaaagtcaggggcatcacgatgttctgctcggccgtgaacatcggcagcagattgaagctttggaagatgaaaccgatgtagttgcggcgcagcagcgtgagctgcttgtcgttgagcttcgtcaggtcgcgcccctggaacacgacgctgccgctggtggccgagtccagaccgctcatcacatgcatcagcgtcgattttccggatccggacggtcccataatcgccgtgaaccggccctgctcgaactgcacgttgacatctttcaacgcatgcaccaggctttcacccgtgccatagtccttcaccagatcgatggcctcgatcgccaccggcgtatgggtcggctggtgaatctggtcaaccatgttctgcaacgcggaattcgacatgttctctccttcttggggccttcgccacttcaatcacgtgctctgacgtgcatatctgcgaatatatgccctacaaccatgccgacccatcacccgcaagggtgaaaaacattcggggctcatccttgaggatgagccccgaacacaacatcgtggtgaattcaccacccgaatacgaccatcatcacaattacggcggcgatgtacaccagcaccagtatcagcagcatccaatcggtcagacgcatatgcgccggatgcagatatgtgcgtttggcacccatgcggtctatatgcgcaccgtgagccaaagctgtgatgctgcgggcgcggttcaggtggctcaaatgggctggtgccgcaatgatcgcacgagcatgagcgctgcaccatgcagcagtgcgggtgaggggattgtgcttgccaatgcgcgcataccgtccacggatgtgttgggtgagcaccaggtcatgcacggtggccgcataggtcggcagccactggatcgcatccgtcacggcggcccctgccgtgtatggcaatcccagtcccgccagaccactgatccaggcggcacgcgaagtggtgaacaacacggtgaacacggcgaacacgatatctgcgatacggagcgccaccaccgcgcatagatccatggtgccggaggtgaccagccagcttccccatcgccacaaggtccagccgggcagatgcacggtgaggagcatgatgcagaacacaatgacgatcaccggcaggaagaatgaccacaccttgagcgtcttgcgtgcaggtatgcgggtggacagcaggaacaggtgctccgcgaggagcatggccgtcaggaatacccagtttccccaaatcgaacacatgacgataacggcgatcatggtgaacagcttcacacgtacatccactcggttgagccaaccatcaaccgggacatagaactgcgaacgcatcagactctcccctcctgatcatggtccaatgagcgcaactgcgcggaatgcagagggccaaagtccactatgcgcccttcctccatacgcagggcatgggtgcagtagcgttccacgagatcatcgtcattgcttgccatgatcacggtgatgccttgcttgttgaggtctcgcactaaggtcatgaacttcgttttgagccggtaatccaacccggacaccggttcatcaagcacaagtatgggtgcctgcgtggccaatgtggaggccagtgccacgagtctggtttgcccggtgctcagccgaatgggatcggcatcttcaatgtcgaacaggtcaaatgcccggatgagcgcattgacacgcttgttcacctcttgggctggcacgcccagggcacgcggggcgaattcgatttccttgcgcacgttgcgcgtcagcatcatatgcaacgggtcctgatcgagataggccacttcacgggccatgcggcgcacccggcactcggcggtgtcgttctcgtccacaatcacatggccacgcgagggcagaatctgagaattcatcatcgacagcaaggtcgtcttgccggatccgttcgggcccacgacgcccacgaatgagccgcgggggatgcgcaggttcacgtcgcgcaattggggggcatcgctgttctcgctgtgcgggtggaggtagtacacatgatcgaagatgatgatcggatcggtcacgtcctgcggctcaagacgggcgattgtcaacggcgtgtggtcgtcgcgagatctgctcacgcccaccgattccagcaacgacgcctcgcggaggaacacttcgcgtgtggtacggcggatcacctcaccgcccaccatcaccaacaccgaatcggcatgctcccgcagccaacgagtgtcgaggtcgatcatcaccaccgacgtgtggttgcgcttcatgaggtcgtccagaatggcatagagatcctgtgcgccgtcttcgtcgagcaccgccagcacctcatcgagaatgagcacctcgggctctgctgcgatggccgagcctatggcgacgcgcatcatctcgccttcggagagcatacgcggatcgcggtgccggagtccctctatatgcagtcggtcaagcacctcatcgacacgggagcgtatttcgtccggcgccacacccctattctccaaggggaatgcgatttcgttctccacctcgttggtgacgaacaaatccaccgggttctggggcacataccccaccttggcggagatattagagacgctcgtgcttttcacgttcatgccagccaccctgatgaaaccggtaagcgtgccatcgagaatatgagggatgataccggtgagggcctgcgccaatgtggacttgcccgaaccggtcggccctactatcccggccagggttccctccgccacataacaactcacatcatgcagtgcccctcttggcgtgccgtgcgccgaggagggcgcatactgccaacccaggttcatcacggtgattacatcggtcacaatcggctccatcaatctcacaacaagtgcgcttggctgggtgaacttctaccctacgttcacacgtaaccgtaagcatactatgtcatctcgttgatatcctgcatcattcgagctgacccgtccatgggcgaacgattcgcgcccatggacggcggcaccgacaaacgggagatcccgcatgcccacgcatgcgggatctccccagaaaagctgttgaccatatgcatggcatacgtcatacatgctcaatcggcgaagccggaggcgcgcaccgcctcgaatccgcctttcagatcgtcgatgatgtcgtcgatgtactcggtgccgatcgacagacggattgttccctgatgtatgccctgatcctccaactcagtctcggactcctgagaatgcgtcgtggaagccgggtgaatcaccaagctcttcgcatcggccacattggccagcagcgagaacagatgcaaattgtcaatgaatacccgggctgcatccttgccgccccgaatgtcgaaagtgaagatggatccggcaccattcgggaagtatttctcgtacaggtcgtggtcagggcgtccctcgatcgatggatgcgagatcgactcgacttcgggcacggttttgaggtaatcgatcactttgagcgcattctccacatggcgctcgacgcgcagtgacagcgtctcggtgccctgcagcagcaggaaggccgagaacggcgagagcgtggcacccgtgtcgcgcagcaggaccgcgcggatgcgggtcacgaatgaaaccggcccgagcgcctcatagaagttgaggccatgatacgagggatccggttcggtgagcgtcgggaatttgcctggcaccgcatcccacttgaaatcgcctccctcgacgatcacgcccccgagcgtggtgccgtggccacctatgaatttcgtggcggattccactacgatgtccgcaccatgttcgagtgggcggaacagatatggcgtggcgaaggtgttgtctacaatcaccggcaagtggtgccggtgtgcgatctcggtgattgcgtcaaaatcgggcaggtcggcgttcggattgccgaaggtctcgaaatagacgagtttcgtgttgtctgcgatcgcctcctcgaatgcgtggggatcgttggcgtcgacgaaggtggtggtgatgccgtcgcgtggcaaggtgtggcgcagcagattgaacgtgcccccgtatatgttcttggcggccacgatatggtcaccggcctgcgtgatgttacgcacggcgtactccacggccgcagcacccgaggcgaccgccaatcccgcggtgcccccttcgagcgctgcgatgcggtcttcgaacaccccttgtgtcgtattggtcaatcgcccgtagatgttgcccgggtcggccagaccgaatcgggcctcggcgtggtcgaagtcgtggaatacatagctggtcgtctggtagatcggcactgcacgggcgtcgctggccgggtctgcgctctcctggccgacatgcagctgcagtgtctcgaaatggtatggtgtgtgggtttcctgtgcgctcatggtgttccttacgctcatgcacgttgccgtgcgtcgttttcgtctggcgaccctcgggtctgggcagcagattagggaactcgcacagcacaatgcaagccagacgttatcgcgattggttatacccgtttatcaatcggcgcctgcgcacctgaacatgggatccgtcagtccccacgagacggaggcgacacgccgagaccctgtggtggaccatctcatccatgcaacacggcaggaatgcgcttggcatatcgttcacctattgtatgaggcatatatggtcgatgactgcaaggagcaatatgccagaagtgctttacgaacgcaatcgcgaatatattccacgcatcgcagcggtgcatgacatgtgcgggtacggcaaatgctcgctcaccgccgccatcccgatcctctcggctgccggatgcgatgtctgcccggtgccgaccgctctgttctcggcgcatactcgctacaaggtgttcaccatggaagacaccaccgacatgctgggcggatacctcgacgcctggcagcaggagggcgttgagctcgatggcgtctactccggattcctcggctcccccgatcaggtggcgatcatacagcgactgtatcgcgagtaccccaagtcgctgcgttttgtcgacccggtaatgggcgatgccggtgagatgtatgccacgtacacggcacagctttgcgaggcgatgggcgcgctcgtcgatggcgcggacctgctcatgccgaacctgaccgaatcctccattctcaccggcactgagtaccccggacaggacatcacgaacgagcaggtcaggcagatcattggcaatctgttcgatatgggcgccaagaacgtcgtgctcaagggcatcgaccacaatgacggccgaattcgcaacttcgtggccaatgccaaggagggcgtggaccggatgaccgaatgcgtgcacgagaaactgccctacatgtgccatggcaccggcgacgcgttcgcctccgccatgatcgggggcgtgatggccggactcgaccttgcagcggcctccagacttgccggcgaattcgtgcacaacgcgatggtccagacgaagttccagcccgactatcaggatcgtggcgtgagtttcgaactgagcctgggagatttgaccagcctcgtggattgagcaggtcgtggatctgacgcattcgccccgcatgaaaatgcggggcgaatgcgtattccaatgccgacacgcacagtggacatcccgaatgtgaataaccgcttgggtgtccacattcgacaccaatgcaagccgggttatccacaaatcttcaaagccggttgcatgcgtgccgcgatgttgctggacttggagcatggacattacatcacagcacaacagcacatcgccgacactggcgaccatacccacgcagacagtcgtggacgcggataccttcgagcaatgcaaggccatgctcttggccccggacctcaccgccaagcagatcggctccctgggagagcggctttgccgggcatggctgatcgaacatcattggcacgtgttggcctgcaactggcactgccggttcggcgagatcgacatcatcgcgcttacctcgcacagcaccatcgtattcgtcgaggtcaagacgcgtagatccacatcatgcggcatccccgaggaggcagtgcatgctgccaaacagatgcgtgttcgtcgggccgcaatatgctggctcggtgagcatggatcgaccatacgccacatcggagtgcgtttcgatgtcatcgccgtcaccgtcacacccaccgacgtcttcattcatcatgtgccggaggcgttctgatggctctgggaacagcattgtcagtcgggctggtggggctcaaggccttcatgattcagttgcaggcattcatctctcctggcctgccgttcttctccatcatcgggctgcccgacgcgtcgctgagcgaggccagagagcgcgtgaaatcggcatgcaccgcaagcggcttcaaatggccccagacccgggtgaccgtcaacatgtcgccggcctcgatgcccaaacgaggttcttcacacgatcttgccatcgccgccagtgtgctcagcgcctcggaattcatagagcccgacgcgttggacaacactgtgctactcggcgagctcaacctcgatggcacggtgctgcccatcaacggcctgctgccaatcatgctgcatatgaaggagcatggcatgaaccgcgtcgtggttccccgtgccaaccgcgatgaggctgaactgattgacggcttggatgtcatgtacgtctcgcatctgggtgaactcatcgaattgttcggaggtcgtgccaactacacggtccatgagattcatgtggacacccgaagacgcgacctgccggagggcaatctgctgcctgtcggcgacatgaacgaagtggtgggccagcacgacgcgaaggaggcgctgaagatcgcagcagccggaggacaccatgtgctcatgaccgggccacccggcatgggcaaaaccatgctcgcctcacgcttccccggcatactcgccccgctgaaccaacaacagcaattcgaagtggcatccattcgttcgctctgcggccagctgggcacccacggcatcgacagcatgccgccattcgaggctccgcaccacaccgcctccgtcgcctcattggtgggaggaggcaccggcctgggagaaccgggatcggtgacacgcgcccaccatggggttctgttcctcgacgaggcgcctgaattcgcaccacgcgtgctgcaatcgctcagggaaccattggaggctgggtatgtcgccgtgtcacggtccaggggaaccacaatcttccccgcacaattccaactcatcatggcggcgaacccatgcccctgcggctatgggtatggcaccggcgaacgctgcacctgcagggaacgcgaccgcatacggtatttcagccgactctccggccccattctcgaccgcgtcgacatgcagctgcaggtatgccccgtttcccacatagggtcccggcagttgccggaaggcgacagcagcgagcgcatccgccagcaggtcatcgctgcacggtccatggcggtggagcgattccgatcattcggctggacaagcaatgcccaagctgcagggtcgtggttacgtgagcacactccccaccgtgtgctcgccgtggtgaaccaggcgctctcctcctatcagatcagtctgcgaggggcctaccgcgtgatgaagctctcatggaccatctgcgatctcgatggacgtacaagtccgaaccttgacgatgtcgaccgcgcgctctcgttgcgcaccactgaagtcaactgaacctacccggccccaccttgaaacggagaagacatgaccgccctcacccatcagaccacgtcacaatcacacacggcacccgcacaacccacgttgagcgccaaggcgctgctgcagtctgacgacgaagcgctcgcccgcatgttgctgacccactgcagcgaatgcgccaatgcgctcatgacctcgttgctgaagggatgcgacagcgaacatccaggtgtggaggcactgcgcgcgctgctcatggttgcatgcgccaccaccgaacaggagcaacgacgcgcacgcaacaccttggaatgcatgttcattctgggcacggcacgctggggccgcaaggcgcgcagcgaaggcgtggcatccttccagctggcctcacaacggtggatcggccgcctgctgcagctgccgaccttcgacccggatgcgctatgcgcactgttcaccggacaaggcgcctataccgttgtcattcccggttcgccctactggccagagtcgttggaggacctcgacgtgcgctctgattgggcgcctccacttgccttgtgggtgcagggcgacgcaacggccctcacatcatgtgatcgcccggtgtccatagtgggttcgcgtggcgtgaatgaatatgggcgtcacgttgcgaggaacctggcctgccagacggccttgaatggccatctcgtcgtttccggcggtgccatgggcatcgatgccgcggcgcattggggagcgctcgaggccatgaatcagctcggagccaaagtagccggaagaaccgtggcgatattcgccggcggactcgaccattgtggccccaccacgaatatgcggctcttcgagcagatctgcgcccagcatggagccttggtgtcggaatgcaccccgagcacgataccggagccacgtcggttcctgctgcgcaatcggctgatcgcggcactggcctattcggtcgtggtcgcacaggcccggctgcgctccggagcgctcaatacggcaggctgggcgaacgagatgaaccgcaggctcttcgcagtgccgggcgagatcacgacacccgcgcatgccgggtgcaacaggctcatcgccgaccagcaggcgtcgttgctctccagcacctcggacatcgagcaactgtgccatgagacccatgcaccgagcatcagaccataaacgtcaggccctatggcagaatcgaggtatgagtccaaccaaggttgaagacatgtatgatgcggtgatcgtgggtgcgggcggggccggtctgtccgcagcgctgggattctaccgcagccaggaggtcgctgatctcagggatcggggcatcgagcccaaggtgttggtgatttccaagttgcaacccctgcgatcgcataccggatccgccgaaggcggcatagccgccagcctcggcgacatggaacccgacgaatggcaatggcattactacgacaccgtgaaaggcggcgattggctcgtcgatcaggatgccgccaagttgttggccaaggaggccgcccacaccgtacgtgacctggagcatgacggagtcgccttctcccgtaccgaggatggaagaatcgcccaacggcgtttcggaggccataccagcgacttcggcaaagccccggtcaaacgtgccgcctatgccgccgaccgggtgggccaccagattctgttcgccctctggcagcaatgcgtggcacagggcgttgcattcgctgaggaatggtacgtgaccgatcttgtactcaacgccgatcatacggccagcgaaggtgtggtcgcctacgacgtcgccaccggcacgacccatgccatcgccgcgcgcaacgtgctcatggcgaccggcggtgccggacgcctgttccatacgacgtcgaattcccacgatctcactggcgatggcatggcattggccttgcaggcgggtcttgatctcgaagacaccgagttcctgcagttccatcccactggtctggcgcacaccggaatccttctctcggaggcctcgagggccgaaggtggcgtattgcgcaatgccacgggagaggcattcatggaacactatgcgcccgagcacaaggacctggccgcgcgtgatgtggtttcaagggccattcgcagcgaggttatggccgggcggggcgtcgccgacccgaaggatccggaagggcccaaggactgtgtatggctcgatatgaccggcatcgacgccacccgaatgcatgaggtgctgccacaggtggtcgaaacgatccgggattatgccgggctcgatcccgccacggacctcgtgccggtcaaaccgaccgcgcattacacgatgggcggcattccaatcaccgtcgatggcgaagtctacattcccacagccgacgggcgtcagattataacgggaatgtatgcggcgggcgaatgctcgtgcgtcagcgtgcatggagccaatcgccttggaggaaactccctgctcgacgcatgtctgttcggcactcgcgccggacgctccatcgccacccgagtggcatccgatccggttgccgcatcggatgtggaaggtgacacgcacgcccttgcgcaggaactcgtcgatgcgtcgaatcgacgcaaaggcatcatcgacacactgctcgaatccgctgactctgcagagggaacgtcccagagcgacaacgcctatgcgctcatcgccgatctcggcaccttcatggaggcgcatgcagccgtggtcaccgacgccactttgctcgacaaggcaatggccgcattacgaaacgacctcattccacgttctgagctactgcatgcccatagcgattccaaagtgttcaaccaggagatcaccgcgattctcgaggcgcatcatctctgcgaactcgcgctggccatgctcacggccacacgcgcccgtgaggagtcccgcggctcgctctatcgcagcgatttccccgagcgtaacgatgccgaatatctcaggcattcattcgtgaacctcaacggcgacgtcagctgggcgccggtgaacatcgtagacatcgaaccaggctcgcgctcgtactgattccagccgtgaccggcgcaaccgtgtgaatgttgcaccggtcacggcttttgcatgcgcgcgcatatacaatatgagacagtattcgacactgtggaaaggcattgcatgagctccccatcctccgtcatccaagcgacggtgacattgcgtgtgcaccgcttcaccccgcgtcccgaacgggagcgccgacattcgtcaagtccgttcggcaggcgcggcggctcgccgttcgcggattccgcacgcgccggcaggccacgcggcaaatcctgggtgcaggaatacgagttgctcgtgcgtcctgaagacacgttgcttgactgtctgctcaccatcaaacgcgatatcgacccgacactggcattccgctattcctgcggccatggcatgtgcggttcggatgccgtcgccgtcaacggcacacccacgttgctgtgcacggcacaagtgcaggattgggtgcagcggctacccaacatctcctaccccgacgacgagggattccgccgtaccggcgatgtcgacgacgcagacaacgccaacgtattcgaggaggatctcgcacatcagatcgacgagggggatcatctgggtgtcatcgaactcgccgcacttcccggtttcccggtcaagcgcgatcttgtcgccgacatcgattcgatgctcgaacagattcgccgtctcaaaccctacctcattcaccacaatgccatcaagacccgtgaggacggcaaggtggatgtgctggagtatctgcagaatccacaggaactggccaagtatgaattgctcagcaactgcatcgcctgcggcgtgtgcgagggggcgtgcccggtctatgccggcggcgaggcgttcatcggcccggcggcgctcatcaatcaggcgcgattcatcaacgattcgcgtgacactgcaaccgaggaacgccttgaggcccttgacaccgccgatggcgtgcaggcctgccagtcggtgcgggcatgctctaggcagtgcccccgcggcattgacgtgggcgaggagatctggcaactcattgcgcaggtgaaagagcggtaaggaagaatgaatatggacagaacgtcattcgaaaaccatgcgcgggcatgggattggattgaaacccgcgaattcgcgcttgaacccgaccttgtgcatgaggcgcgcacgctgatgcaggaagacaacgacccgtcggtctccgcatgcgaaggcgccatgctcagcatgttcaagacgatgtccggcgcatcgtcggtcattgtgatcggcaccggatcattggtacagacggctcgaatcgcttgttcactcaatgacgacgacaaactcactgccgtcgactccacacctcaaggtcatagccagatcaagagactattccgcaccgccgccacgatgacccgggccacgctgcgcaccgtcaacgcagatccaacccaattcttgtcgcgtctcaacggcgacgactacgatctcatcgttgtatgcggcgatgcctcgaactaccctgccgcctacgagcaggcaccgcgattgctgcgcagacatggcgtgatcattttcaccgatgtgttggccatggaatcgccggattccaaaggcggtctcaccaacccggcggatcgcggcgacaaggccgtggccatgcgcgaactcatcgacgccgtgaccgatgacgaccgcttcatctccgcactctcccagaccggctggggtatgctcatcgccacattgcaataattcggcatggtggagcggatcggaattggattcccgtgattcgcaccaccatgccatacggatcagtgcgcaccggtctgcctgggaaccatgctggtggcgacatcgacggcctcgtcgatgtcgtcggtgatcgtcaccagatcgggatcgatgttcgagatcatgccccgttcacgcaccggcccgtcaatccaatcgaacagccctcgccagtatgcggaatcgaagagcacaatcggcattttcgccaccttctgcgtctgtaccaacgtgagcgcctcgaaggtctcgtccaacgtgccgaagccgccggggcaaacaatcacgccagacgagtacttcatgaacatcgtcttgcgcacgaagaagtagcggaacgtcatgccgaggttgatccacttgttgagcccctgttcatgcggcaattcgattcccagacccaccgatttgcccccggccttggcagcacccttgttcgccgcttccatgatgcccgggccgcctcccgtgatgacggcaatgtctcgctcggcgatcttcgcgcccattgcgacggcggccttgtagtccttcgtattgggctcgacacgtgcggaaccgaagatgctcacggcaggaccgagctcggccagcgatccgaagccatccacgaattcggcctgaatgcgcagtacacgccatgggtcgcgatgcagccaatccgtgtcggaatcattgcgcaggaagcgttccgaagtgctttcacttggaatcatcttgccgcgcaacaacaccggtccctgcgaataggtccgtccgagcggctcctccgcatgattcatcgtctgcccgccattcgcattctcctcattgttggattgcatgccactccttcgattctgtggtgtatttccaactgcgagtgtagcgagtgcagaccccggccatgtaacatggccacctcagctgcgggagtcttcttccttgagttgcgccagatcctgctcggcatccctacccatggtctgggagaccacaacggtgccatcccggagcgtgcgcgtggcctcgagggggcgttccatcgcggccaaacgctcctcgacggagtccatgcgggcgaatctggccgactgccggctcagcagcaccgccgacaccgcagccgccaccagcgaccccagaagcacgccgaatctggcctccgcggaaagctcagcgttcgcatacgccagcgatgcgatgaggaaggagacggtgaagccaatgccgcaggcgattgaagccgggaacatgtcgcgcacgcgcagtcccttgggcatcgcaaacgggccgatgtgggtggacagccatgcggtggccatgatgccgagcggcttgcccacgaacagcgccacgatgatggcgatgaccaccggagagaccagcaacattggggtgatcgaatcgaagtgcacaccagtggcgaagaaggcgaagatgggcaatgccagcaacgccgagaacggctgcagcttgtcggcataccgttcggcacgcggcgaacgttcgccgtacatggcacgtgcaggcgtgagcaatcccacgagcacgccggccaatgtcgggtgcacgccggcctcgtacatcatcacccaagccagaatgcctatgacggccacgccgaaccatggcaccttcttcatgcgcaccaggaagtaccaggcaaccgcgcagatcgcaatgcccacaaaccagtaccaggcgttgagcgacgagaagaacacggcgatcagaatgatcgccaacagatcgtccaccgtggcgagcgtcatcaggaaggcacggatcgagccaggcaacgccttggcgaacagcgcgagcaccgccagcgagaatgcgatgtccgtggccgtgggaatcgcccatccgtgtgccgtctcggcaaaactgaacatcgaaccgttcgcgatgatgaggctgcccggatctccggcaccgaagttcgagaacagtgagatgacggcaacgaacagcaccggcggcaccaacatgccgcccaccgcacagagcatcggcaccgcggccgcgcgtacattcgacaacgagccggtggtgagttcctgacgcagctcgagcccgacgaccaggaagaagatcgtcagcaggccgtcctgagcccaatggcccaaccccatgtcaatgttggttcccggaatgcccagatggaaatgcgaaagctcttcgaaccagtggtaggtcgccggcagattcgccagcaccagaccgagcaacgcgaatccgagcatgatgagacctgatatgcggtcggatgccgccactttccgaatcgatgcccacactccacgctgcctgttgctcatgccgccctcgctgtactcctatgccaatatccagctatccattatgccgcattcacccgccatacgcccaatgggacgcccccgctcatacacaatccgcaaaatccgcggccacgggtcccactcccagcttgcaaagcgctgcgtctagctgcctgcacatccgctcgatcacgcgcacagggcaagcgaggttgatgcgttcgaaaccactgccctcctggccgaacagatatccttcgtcgaaatagagcctcgcctgttcgtgcatgaacgtctccagctcatcattcgaaaggcccagcccgcggcaatccagccatgccagataggttccctccggctcgatgagccgtatgccgtcgtgggtgtcggcgaaggcacgtacggtgtcgagattacgccgcaccaccgcgagcatctcctcgaaccagtcctcgcagcgggcataggcggccatgcatgccaccatgcccagatgattcaccgtgctgccgccggttttcgccgcggcgatgtcgaactcctgcttcaccttggcattgtggaagatcgcgttcgagcacagcagacccgccaggttgaatgatttcgacggtgcggtgaactcgatgagatggtctgcataccgctcccccaacgtgccgaacatcgtcacggcgtgcccggggtgttcaagatcgccatggatctcatcgcatagaatcatcacatcgttggccacgcagatgtcgccgagcatacgcagctcctcggccgtccacacacggcccaccgggttgtgcggattgcacagcatgatcgccttgcagcgcgggtcggaggccttgcgttccagatcctcgaaatccatcgaataccgaccggtctccccatcaaacagcagggcgttgttgaggatctccagaccattgttcatggccgcgttcgtgaacgggtagtacacaggtcgctggatgatcaccgcatcgcccggatgggtgaacgcacgcaacgccgtgttcaccgccggcatcacgcccgccgaaagcgagatgagcttcggatcggcctcaagaccatggcggcggcgcatccagtcgcacacggcggccaagtactcgtcggtggcatagtcatacccgaatacatcattgcgagcagcatccacaagcgcctcgacgacggccggcggcgtgacgaactccatatccgccaccgacaacgccagcacatcctcatgaccgacacccagctcggtctcgatcatcttccatttcaccgaagttgtgtcgtgccgctctggccaggtttcgaaatcgtacatattccctttccctccgtcgctgcggtctgttctctcatacggtgggtcagcttaacgtcgccatgttacggcggcaacaccacagttcacgaatgggttacggccaacatcgcgccgcatgcaattggaaaagcccttgagcgtatgcacgttcaagggcttgttgtgcgcgagacaggattcgaacctgcgacctgctgatccgtagtcagctgctctaatccgctgggctactcgcgcatgctacctgaatcgcatgcatttgcacacagttcacatagccaagtgcgcgagacaggattcgaacctgcgacctgctgatccgtagtcagctgctctaatccgctgggctactcgcgcaattgcttgcttcaggcaactcgactaacatacaacgtttcatggtcaatcacaacttcggcgtgtcgaaatcgtgaagatgacggcattcacagggcatggatcacacgtcgccgctcgggccggaccatctgcggaggcacgccctccgtcacgcaatcggcattcaccaccacttcggtcacatcgtccatgttcggcaattcgaacatcgtctcctcgagaatcgattcgatgatcgaacgaagccctcgggcacccactccccgctccagtgcggtgctggcgatggcttcgacggcggcgtcggtgaacgtgagcgtgaccccatcgactgagaacagtttctggtattgcttgagcagcgcgttcgtgggtttggtgagtacgtccttcagatcgtccaccgtgagttctcccagcgtgcacaccaccggcaggcgccctatgaattcgggaagcaggccgaactccgccaaatcgtcggcattcacctgtctgtatatctcgtgttcgtcgatcggattcacgcgccacgacgccccgaaaccgctttcatgccgacccagcctgcgcgagacgatctcgtcgagccccacgaaggcgcctccgcatatgaacaggatgtcgctggtgtcgagttccaccgtctcgccgtccttgtgcctatgtgcgccgtcgaccggcacatgtacgagcgttccttcgagaatcttgagcagtgcctgctgcacgccctcgccggagacgtcgcgggtcatcgacgtgttgtcgccgctcttgcgcgcgatcttgtctacctcgtcgatgtagacgataccgtgtcgcgcacggtccacgtcgccgtcagccgcctgcagcagacgtgacagcaccatctcgacgtcatcgcccacatagcccgcctcggtgatggaggtggcgtcgacgatgatgaagggcacctgcatcgccttcgccaatgtctgcgccaggtaggtcttgcccacgccggtcggtccaagcaatagtatgttcgacttcgccacactcacctcgtcgagcggatcgagaatcgaacgtgtcgaatccgcaagcctggactgctcgaactggcggtgtgcattggcatcgtggcgttcaatctgcgcgcgtttgaaatggttgtagaccgccacgctgagtgtgcgcttggcgtcgttctgcccgatcacgtattggtcgagcacatcgcgaatctgcgagggcttcggcagtttcaacacctcaagacgcgagtccttggcgttctcctcgctcaggatctgcacgcagaggccaatacattcgtcgcagatcgccacgccggcaccggccaccagacggtgtacctcatgctcgcttttgccgcagaacgtgcagcgctgcacgccgtcgttatagctgaccacacgtcccatattcaccctcattccgcatgcatacaaaaacgggcacgtgcactgggcacgcacccgtcattctagaacagatcgcagattaccgcattcgtcaggctgcgtcaggagcggtgctcgagcacctcgtcgacgatgccgtattccttcgcctccgaagcggtgaggaacgtgtcgacctcgatgtcgcgggagatgcgttcacggctctggccggtatgcttggcaagcgtgttctcgagccattcgcgcatacgcatcatctccttggcctggatctcgatgtcggtggccttgccgaagccctggtcgattgcaggctggtggatgagcacgcgggcgttcggcagcatgagacgcttgcccttcgtacccgccgccagaatgatcgccgccgcggatgccgcctggccgaggcacacggtctgcacatcgggtttgatgtactgcatcgtgtcatagatggcagtcatggccgtcatcgaaccgcccggcgaattgatgtacatcatcacgtcgcgattcggatccatgctctccagcacgaggagttgggccatgatgtcgtcggcggacgtgtcgtccacctgcacgcccaggaagatgatgcggtcgtcgaatagacgggtgtaggggttctgtgtcttcatgccgtaaggcgtgcgctcagtgaactccggcaccacgtaccggttctgcgcggccagggctcggtcacgcgcggccgcgggctggaaaccggcaatgcctgcagggcctgcgagacgctcggccctggcgacgaactgtgcttcttcggatgccatgcttactccttatcgctgttcatcgtctcgtgcgtggagacgagcttgtccacgaagccgtactccaacgcctcctcggcggtgaaccagtggtcgtattcgttgtcgcggtagatctcctcgatcgtgtggccggtctgttccgcggtcagctcgccgagggtcttcttcatgtccatgatgagttcggcgttgatgcgcacgtcggtggtcgtgccgccgatgccgccggacggctggtgcatgagcacgcgggcgtgcgaggtgaggaaacgcttgcccttcgtgcccgaactcagcaggaactggcccatcgaagcgcacatgccgatgcccaccgtggccacatccggttcgatgagctgcatcgtgtcgtagatggccatgcccgcggtgatcgagccacccggcgagttgatgtacagccagatgtcgctctttggatcttcggcggcgagcatgagcatctgtgcgcagatgcggttcgccatatcgtccttgacctcctcacccagccagatgatgcggtccttgagcagtcgattgaaaatcggatcggccggacccgccggcatgtcttcaccagccatgcgaggggacgtgatcaaatcactcacgttgtctccttaatctttgcagattttcctatgtgtacaaaccagctctcccggcaatctattccccgtctgccgaatacggcgaacagattcgcgcgtcagccgagcacagtcaccgaccggcgttccaccacactcagcgtcgcgtgcgaggcgagcaaagagatcatggaaataaacaccaccggcacgaacaggttcatcggcgcctcggtgagctccatcaccaggcacatcgccatgagcggggcgttctgcgaggcggagagcagggcgcaggcgccgagcagcgcgtagacgccgattgagttcgtgccggtcatctgcatccacaggatcccgaggatgcatcccatcgatgcgccgagtgcgatgcccggcgtgagcacgccgccggaggcgcccgcgcgaatcgtgaacagtgtgatgagcgccttggcggcgaatgacagcaacaacaatgggatcagcgacatcgtcggcgtgcccgagaatgccagctgggcggtggcgcggccgttgcccatcacctgcggaatccgaatcgccacgatgccggtcactgcaccggcgagcggcagcatccatagaatcgcattgccggccgccttgttcctctcggcccactgcgaccctttgcggaacaacgcgccgcaaacgcccagaatcaccccggcgggtatggcgaaaaccatgagatcccacgagaagtgcgcatccacatgcccgatcacgtagaacgtgtgcgtgcctttgacgagggtggccacccaggccgccagcgtggagcagaggaaggagaggatcacggtgccaccgctgacatcgacgagcagaatctccacggcgaagaacgcacccgcaagcggggcgttgtagacaccggcaagaccggccccggcggtcacggcgacgattgtgcgcatgtcggtcggattcagccgcagcatgcgtgcgcatcgctgcgcgagcatggcaccgagttcgcgcggcgccacctctcggcccaccgacagaccggtgccgacgatgaagatctgcagcagcacatgggcaacggtctgccagataggcatgagtctgcctgccaccgcctgtttgaccgacgggaccgccttcgatttcgtgcgcagggcccaccatgcgatggcggcgaccgatgcgccgccgaacaccgatgccgcacgcctccatgccggcgtcagaaaggggccgggcagttccggatgctccacgaagcccaggcacaggtgttcgatggcatagagcagcaatgtgagcagccccgcgcagatgcctatgagtgcaccgagcaccagtgtggagacgagcaacgagaaagcgcgggagaccaccggcggtcggccttcaccggtggcatcggcacgtgtgttcgccatcgtcgcgaaatcgttgtcgaaatgtcccccgctttccgcgcatgggggctgggcgaaggaggaaagaggcgaatcttgttcactcggagtggacatatcgggggcgctccaaagacgttcggatatgggaagacccccgccgagggcaggggtcttgaaggaaaatgagatcactcggcgtcggtgccgtcgtccgaggtgaggttgtcggcgacggcggccgctgcagccgctgcggcaactgactcatcctcttcggcctgtgcctcggcctcttcggaaccgaggaagccactcagatcaagcggttcgccgtcaacggtgaacttcacctgacgcatgccggcgagcatgcccttggaacgggccacctcctcgacggcggagccgatctggccgttacgcatgagggcctggatgaacatgttcggatccatgccgtactgctgggcaatcgagccgaggaagttgaacacatcggactgggagacctgcacgtcgagcttctcggcaagggcatcgagcaccatctggtccttgagcatcttgtcgacggcctcctcggcctccttcttctgatcggaggtcgccttgccggcctcgacgcccatcgacttgagctgctgctcgaccatgttgttgcgcacacccttcggcagcggaatgtcaaggccttcctcaagggtctcgatgaacgcatcacgtgcgatcgtggcctgacggccctccgcatcggcctcgatgttcttgcgaatctcggccttgagctcgtcgagcgtgtcgaactcggaggcctcctgggcgaagtcgtcgtcaagctcgggaagctcctcggccttgacggagttgaccttgaccttcacctgggccttctcgccctcatggtcgccgccttccagcgtgctttcgaaggtggtctcctcaccggccgacaggccttcgagcgcctcgtcgagtccgtcgagcatggtgcccgaaccgatctcgtagctcacgccctcctgggagtccacggtctcgccgtcggtctgtgcggtcaggtcgatgttggcgaagtcacccttctgtgccggacggtcgacacccacgagggtggcgaaacgctggcggagggtcccgaggcggttgttcacatcgtcatcgctcacctcggccttgtccactgcgatctcgaggccctcgagattcggcagctcgaactccggacgacgctcgaccgtggcggtgaacttgagcttggtgtcgtctgcggcgctctgcggcatctccacgacctcgatctgcggctggtccatcggacggatgtccttctcgtccagggccttggcatacatatccggcaatgccttgttcacggcctcacccgcaacggcaccgaagccgacgcgctggtcgacgagcttgcctggcacatggcctttgcggaagcccggaacggtaatctgctcggcgatttccttgcgagcatcttcgaggtacggatcgaactcatcctggtcgacggtgatggtgagcttagccttggtcggctcaagattccttacgctgattttcacgcttgcgctcctgaaagttctgttctattggtatatcaactgccccttgggcaaccgttacatgatagcgcgggacagcgactcgctgagcaagtcgacctgccatggtctggcgccttgttgcgcaaggaattgggccacatcacgacgatgtggatggtccgtccagcataggttgcgcaggatctgcggcttgagcagcacgtcggtaggggtgcaggtgtcctgcgagatctggttcagcacggccttgcacctctggagctgccggtaccgtttgggctcatgggtctgccagaatttcgcagaccgtggcgcattcaccacgtcctcaccgtgaccagccgctttgccgggaagctcgggaagctcgtcggaaggcaggtccagcgcctcctggattgtccgtttccatagcgacggcttgactttgcgctggatgggcgcatagcgttcgaacatcttgtcctgctcgttgcccagatgcatgcgcacccgttcgttgagcgagcgcactgcacggaactgactggcattgtgcggcttcctctgtgccgcttcgatgatcgcggaatccgccaacagcaacgatggcgagatgtcatattcgcgggcgagtcggtcccgttcggtccatagcgccttggccacggcgagtcctcgacggtcgcgttgcagcacattgatatgcgatatgcgcatccacggcaccggatgcggtttgggaggctgcaatccctcgtgcagggcataatcgaactcctcctgcgcccattcccacttgccctgccgtttcagctcatgcgtcattgcccgctcgagatcggagagcaattcgacgtcgagtgcggcatagttgcgccaatcgcgaggcaacgggcggtatgaccaatcggctgccgaatgctccttggccagcgtgatgccaaggaaatgcgccgtcacataggcgaggccgacccgatgcagccccaatagcttggcggcgatctcggtatcgaacagccggcgcggcttcaggccaatctgggcgaatccggggaggtcctgacgtgaatcgtgcagaatccattccgcgtcgcccacagcctcattgaacgcattccaatccacaccctgttcatcgagggcgatcggatcgagcagcgctatcggtgcaccgtcgcgtttgaattggatgagccagtcctcgtggccgtaccggtacccactggccctttcggcatcggtggccagtggggtgttcaccgctgcgtattgttcgcagatgagttcgaagccagccaaggtgtcggtgacttcgggaaccccttccttcggctcggtctgcaacaccggttccttgttcaccgaatccaacgcaggtccctcctgatgcacggtttgccttcaaccgtcaaatataacgaatgcgctgacaccggtgtcagggatcatgtgtcggcgcattcgccgtcgcttagacgtagaccgtgaatccgtggctctcgaactgctggcgcacgcggtcgcgcaacgcctgggaaggtcccttctggtcctccaacgggtaagggattcgcagctcatgccacttcggacgcccgagctggtggaacggcagcacgtctatatgctccaccgcgtcgccgaagctctcacagatgcgggccacattctccacgttctcctccgacgaggtgagcccgggaaccagcacgaagcgcacccagatcttcttgcccctcctgttcaaccgctgtccgaaatcgatggtgggctggagcactcccccggttacccgcttgtaggtctcctcgtctccggacttcacatcgagcaggcacagatcgatgtcgtcgatcatttcatccgaatagttggcgttgaggaagcccgaagtatcaaggcaggtgtgcacacccatctccttggccgcccggaacacccgcgacacgaatgccggctgcatcatggactcgccgcccgagaaggtgatgccgcctttcgtggcttcgaacaggtccttgtaccgttcgatcttgaccaccatggcatcgaggtacaccggcttgccgtcgcgcatcttccaggtgtcggggttctggcagtactggcagcgcagtgggcagccgctcaggaataccgtcatgcgggtgcccgggccgtccaccgacgtattgatgtcccaggaatgcacaaaacctatgtcgccggttttcaacgcattgatgcggtcacgccgatcgagtccgatgggcgattcgaatcctgacagaccgcccatgagcgtcttgcgctggtactccttcgacgacttgagcatgtgccgcgtcgtggtgcggaatgcggatgcaccgtgattcgactctgaattcgacatggctacctccagtatcactatagccgaatgcaaaggggcggggccgaaaagccccgcccctaccggcgataaaatcgcctctcgcgtgccttagtcctcgaccgcgccctgatggaaggtgcgggaaatgacgtcaagctgctgttccttcgtaagcttgacgaagttcacggcgtaaccggagacgcgcacggtcaggtgcgggtacttctccgggtgctccacggcgtcttcgagctgttccttgcgcagcacgttgatgttcgcatggtacagtccatggccgttgcctgcgtcgaggatgccgacgaggttgctgatgcgttcgtcctcatcgcggcccaggccgtcgggtgtgatcgtgttcgtcagcgagatgccgtcaagggcgtcgttgtaatcgatcttgcccaccgagaacatcgaggggagcatgccatgggagtccatgccgttctccgggttcgcgcccggggcgtacggcgttcccttggcgtggcccgacgggaaggatccggtgttcttgccatactcgacgttcgaggtgatcgtgaggatcgactgcgtggggacggcaccacgatacaccggcaggcgcttgacctggcccatgacggtggacacgacccacttggcaatgtcatcggcacgatcgtcgtcgttgccgtaaagcgggaactcgccctcggtgcggtagccgaccaccagatcgtcgtccgcgccttcgacatattcgtactcgtgacccggcatgtccttggcgtccttgttgtagattgggtacaccttggcgtacttgcatgcggaaagcgaatcggcggcgatcgacaggccggacatgccgcagcccagggtgcggtagacctcgcggtcgtgcagcgccatctcgatggactcatacgcatacttgtcatgcatgtaatgaatgatgttcagcgcttcgacgtaggtctccgaaagccattcgagggccttctcatagttggccttcaccttctcgtaatcgagcgtgccgtcagcctcgggctggatcggctcgatgatgcccttgtcgatcacctgcatgccggtcatctcgtcacggccgccgttgatcgcgtagagcagcgccttggcggagttcacgcgagccgcgaagaactgcatttgcttgcccacacgcatcggggagacgcagcatgcaatggccgcatcgtcaccccaatggttgcggatctccttgtcggattcatactggatggccgaggtatcaatggagatctgggcgcagaaacgcttgtagccttccggcagcttcggatcccagaaaatcgtgatgttcggttcgggtcccggtcccaaatgctcgagcgtgagcgtgttgagcagacggaacgacgtcttggtgaccatggtgcggccatcgtcgccgaagcctgcatccgaccatgtcgcccagtaggggtcgcccgagaagatcgaatcgtagtccttggtgcgcaggaatcgcacgatgcgcagcttcatcaccagattgtcgatgatctcctgggcgtcggtctcggtgatcttgccttccttgagatcgcgctcgaagtagatgtcgaagaacgctgacacgcggccgaagctcatcgcggcgccgtcctggctcttgatggaggcgaggtagcccatgtaggtccactgcacggcctcacgcgcgttcatggcggggcgcgccaaatcgagtccgtattccttgcctaggttgatgagcttcttcagagccttaatctgctcgtcgtgctcctcgcggtaacggatccagtgctcgatctcggtctccgagaagtcgttgcggtacgggatggcgtccttgtcacgctgcttgaacttaatcagcgcatccacgccatacagggccacacgacggtagtcgccgatgatgcggccgcggccgtaggcatccggcaggccggtgagaatcttgttgtggcgtgccactttgatgttcttcgtatagacgccgaacacaccgtcgttatgcgtcttgcggtacttggtgaagatcttcttgatcgccgggtccggctccttgccggcctccttgatggcctgctccaccatgcgccaaccgccattcggcatcatggctcgcttgcatggctcatcggtctgcaggccgacgatcacattgtcgatctccggggaatcgatatagccagccgggaaggcgtcgatatccgccggcgtgtgggtgtccacatcatagacacgctgcttgcgctccaccgccagatagttgtcgtcgaggtacttccacaggtacttcgtcttgtcggtcgcatccgcgaggaacgattcatcaccctcgtaaggcgtgtagttcttctgaatgaagtcacgaacgtcgatgtccttctcccagttgccgggaacgaacccctcccaagcctgttccttgatggcttccggggacacctcggccacgttttcaattgctgacattgccactccttctgggtgtagcttgtatacgacgccactttgtgccgcatctctaacaaaatccatagtacttcaaatcgctgtgccgcgaccagcggcaaacgcgtgagcttggtcacatttccacttgtgcatcgcccacattctgcacaacacaaggcgggcgccctccattccggatggccgcccgccaaagtgggtatgcacataatatacacattcagactacttcttgtccgttccccaattattccagtccctgtcctggtcctcccatttcttgttgcgcttcttggcgatctcgagcgccttctcggcgtcctcacgcgtcgcatacggtccgagacggttctgcatcggggactgtgggccgagctccacttcaccggtcaccgtattgtagtaccactcctgcggttctgtcatgtcattctccttgtctcacatcatggggtatagctacgcggttattcgcggaatgcgtcggtgaccggcagacggcggtcgcggccaaatgcgagcgcgctcaccttcggccccaacggatactggcgacgcttccattcggcacggtcgacgagacgcatgacggtgtcgaccgtctgctcgtcgaaatccgcatgggcgagcagatcggcccgcccttccgaatgttctatataggcggtgagcaccttgtcgagaatatagtattcaggcagcgaatcggagtccttctgctcgggccgcagttcggcgctcggtgccttcacgatggaattgttcgggatgagctcgccgctggcgggcacgacgccctccgcattcgggtcgtagccgaccacgggcaatgccccgagccccagaccttccttgagcgctttgttgcgccaacgcgacagctgccatacctttgtcttgaacacgtccttgattggagcgtatccgccgacggcatcgccatatatggtggaatacccgcaggcgagctcagacttattgcccgtcgccagggccagcagccccttggaattcgaatacgccatgacgatgacgccgcggatgcgggcttgcagattctcggcggccacgccctcgagatccaactgcttctggaatgcatcgaattccggtttaatcggctgcacatcgtacgaggcgcccagattctcggcgagttgggccgcatcgtccttcgacccctccgacgagtacatgctcggcatggatatgccctgcacatgctcaccgccaacggcatcggctgccatggtggccaccagagcggagtcgatgccgcccgacagtcccaggcacactccgttgaaaccgttcttcaccatgtagtccttgagaccgagcacgcaggccgtgtacacttcgccgtcaggatccatctcgggtgcgatgtcggccggcttctgggtggccgcagcggaatcgatgtcgatgtagctcaggtcctccacgaacatcggcgagcgttcaagcaacgtgccatccgcatccacaacgaaagtgcctccgtcgaatacgaggtcgtcctggcctcccacctggttgacgtagatcaccggtgccccgacctcggcggcacggcgacggcacagctgcagtctggtatcggttttgccctcctcgtacggcgaaccattgatcgtcacgagcacatcgatattccgctcggcaaaatcggcgacaggaccgccctcctgccagatgtcctcgcagatcgcaaaacccagcctgacgccgtcgatgtccatcgtcaccgaacggtcgcccgacgcgaagattcggaattcgtcgaatacaccatagttcggcaggaaatgcttgtcatagcccgcccatacgacgccgtcgtgcagtacgacaagccggttgtatggcttctgtgtgctgtgctccgtgcccacggtgcctacgaccacatagagcgaaccgagtccgtcgtcggccagacgctgcgccaagtcattggcggtgtcccaggcggcctgacggaaggtgcgccgcaatgcgagatcctcaatgggatagcccgtgagtgtcatctcggggaacaccaccacctgtgcgttgttcgaggcggcgcgtgatgcgtattccagaaccttgtcggcattgcccttgagggcgccgacacaggtgtcgatctgtgcgagtgcaaaacgaagcttggtcatagcttcctagtctaggcccgtcaccgttacaaccgcaccgttcagcgcatcgcgtgtcggaaggagcacgatgcatcagtggcatcagtgattggtggcgggcaaacgcgcaggcggcgcccggcaaggttgaggaacgtaaagggcgcttgcgatccagtgacgaagcctttccgggaacgctccgacactccctcggcgatcgccccctcatggcactcagctcagatgctcgagcacttccaacgccgagttcgcatagaattcggcaccggttttcaccgcgtcatcaagcgcaacgaacttcggtgagtggaggtcggcacaacctccggagccattcgatcctatgaaggcgaacaacaagcgcgtgtggccctcgtattccgcgaaatcctcccctgccatcgatgggtgaatcggctcgagctgcgcgtattccggcacatggctcatggccagcgtcgccagatccgggtcgctcaccagcggacgctggaaatcgtcccacacatagtccacggcaatatcgtaggcggcagccgtactttcgatgacctgcctgaatcggcgttccgccagatcgccgtcctcacggtggaagtagcgtgctgttccttggaatccggcctcggctggcaccacgttccacacgtcgccgccatgcacctcggtcaccgagatgacgagtggatggaatggcgaggcattgcggctcacaatggtctgcagtgaaaggaccatcgccgccatcgcctcaagcggcccggtaccccggtgcggatacccggcatgagtgccctgtgcatgcaggttcacccggaatttcacacatcccgccatcatgggatccacgccgacggcaatctgaccgggcttataatcggggttgttatgtgtgccgatcatcgcgtcgaggccgtcgaccaatccggcatcggccaccgcacgcgccccctgcccgagttcttcggccggctggaacaccaatcgaatggtcccgtggatcagctcccgatgagccgccagccagaatgccgcccccagcagtgatgtcatatggatgtcgtggccgcaggcatgcatgaccccttcgttctcggacgcgaagacgagtccggagtcctcgtgcacgggcaacgcgtcgatatcggcacgcaaaccgatctgcggtccatcatgctctcccttgatctcaccgatcacaccggtgtcaagcgggttgtccagcaccgtgatgccgtgtgattcgagcagattgcgcagcctcatgctcgtttcgaactccttgaatgagcgttccggatgccggtggagccggcggcgaatgcctagcagctcgtcggtcagcgcaatctcgacatgctcagtatggtcggtcatatgccctccttcgaagtcggcaacgaggtcacggagtccaatccgtgttgcccatacagcatgggcgcaatgcaaaaggggcgccgatccgggcgccccatcgttcagttgttctgtgtgcgacgcagcaggtgcttggcgatcgcattggcaatcgactgcaccacctgtacgagcaggatcatgatgatcacagcggtccaggtgacggtctggtcgaacttctggtaaccataggcgattgcgaagttacccaggccgccgccgccgatgtagccggccatcgccgacatgtcgagcacgccgatgaacaggaaggcataggcgaggatgagcggtgccaaggcttctgggatcagcaccgtgcgaatgatcgtgaatttcgaggcacccatcgaacgcgcagcctcgatcactcctggatcgacgggcacgaggttctgctcgaccagacgggaggttgcgaaagtgcacatcacgcacatcgggaaaatcgccgccgcggtgccgatcgacgtgccgatcaccttgatggtgagcggctgcatggcggcgaggaagatgatgaatgggatcgggcggatgatgttcaccagaatgtcgagaatgcggtacacataccggttctcgaacaggttgcccggacgtgtgccgtagagtatgacaccgagaatgagaccgaggaagcctccgacgacgattgtgatgagcaccatctgcagcgtctgcaccacggattgtccaagcaggggtctcaagacgctccagtcactgcgtgaggcgagggtcgtctggtcgaatgcgagaatatgcatcacttcgtctcctttcgcgcaccgttcgcgtcatcagacgcgacacgggtgtcggcttgcgctcccggggtgtcctgcccgttgattcggctgacggtgaccacatcgtccacctgctcgaaatcaagcgcgttcgtattcgcatggtcatcagcggcgcgattctcgggggcggcaattcccgctcgctccaccgcctgcgcatagtcgaccggttccgcggcggtgccgaaatcgacgatgtcgctgttttcggcgagttcggcaaggaacggctccacttcggcctccggcccgtcgaaggtgtaggtgattgcgccgattgcgacgccctgcacggtgtcgatgccgccatagatgaggttgcttgccacgccgtgcttcgagatgagctcggagatgttctgtcctgaggacggtatgcgcgtgtttgcattctcgtcgtcgatgtcgtgctgtcgcacgatcacggtgacgaggcggccgctccaatcccgatgcatctgttcgacgcgtgtctcgtctggcaatcccgacatggcggtggcgatgaaccgcttcgtcacctcctcctgcggtgcggcgaacacccggtacacggtgcctttctcgacgaggcgcccgccgctcatcaccgcgacatggtgggcaatctgctgcacgacgttcatctggtgcgtgatgagcacaatcgtcacgccgagctgctcattgatcttcctgagcaattcaagcacctcggtggtcgtctcggggtcgagggcgctcgtcgcctcgtctgcgagcaggatcttagggttcgtggcgagcgcgcgtgcgatgcccacacgttgtttctggccgccggaaagctgtgccggatacctgttcgcatgctcggagaggcccacgaactcgagcagctctttgactcgcttgtcctgatagtctttgcgccagtggtcgagctgcagcggataggccacgttctgcgcaacggtcttcgtggagaacaggttgaactgctggaagatcatgccgatcttctgtcgtaccgcacgcagtttcgactcgctcatgcccgagacctgctggcccatcaccgtcaccgtgccgcttgtcggattctcgagggcgttgatcatgcgcaccagcgtggatttgccggctcccgaatagccgatgatgccgtagatgtcgccctcgtcaatggacagtgtgacatcgtcgaccgctttcgtctgcttcttgccacgcccggcatacaccttgctcacgtggtcgaattcgatgatggcgttcttctcttgcgtcatttccctctaacttctccgtttacgtcgaggttccgtccggtgcctgcactgcggccggatactcgcatatggtagcgcgacccaatggcgagtgtgtgaacgtcgtgtatatgggagcaggttggggaatagctctccccaacctgctcattgtgttcagcgatctgcagccatgctatgaacggctcacttgttcttgatatccgtctcgatctgcttcagatagctcgccagctcctgctgcgagaacttgtcggcaaacaccgcggtgccgccggactcctcctgcagggcgtcgaggaccggcttcgtctggtagatctccacgcacttcttgtacacctcgttgttcacatcgtcggcgcgcacggcgaagatgttgatgtatgggcgcgcctcctcggattcggcgttgtcctggtagatcgcatcggtgggcttgagccccgcgtccgccacatagtcgttgttgatgacgcccgcggacagatcgtcgccgcctgccttgagcgtgttggcaatctgctcggccttcatcggcacgaccttgaccttcgacttcgcctcatcgatgtcctgcgggatcgtgaacgccgtccagtcgcctttcagcgtgacgacgccggcggccttgagcacgccgattgcacgagcctggttcgtctcgtcgttcggaatggcgacggtggagccagccggcaggtccttgatgtcggtgtacctcggcttgccgtccttgtcgaacgcggagtagacgccgagcgggtagatggcgacgcctccgagcggctgcaggttttgcttgttctgcacgttgtagttggccaaatagagcagatgctggaactcgttcatgtcgaggtcgccctgcgccagtgccggattctcgctcgtgtagtcctggaagtccttgatctgcacgtacacgccctgctgctcggcctgcttggtgaactccatccactgcggatcggtggcgccgaccacgccgatcaccaccgggttgttcttggagcccttcggtgaatcgtcgttcttgttcaccgcgcgcatgccgaagacgatggcgagcacaatcgccaccacgaccaccacggcgatgacgatgttgcgtgtggtgtggttgacgcgtaccggttcctccggtgtgttcggagcggttggctgcgtgttgttcgaagtcattgccttgtcctctgttgttcctctgttgctgttctctgtgtgatctgccggaagattccctctcccgaacaccgtgttcaaccatacggcatgggtgtcatgaacgcacgcgcgttgttatcgaatctgcttatagtgcgcgcaaaccgaaccggcctaagcgctcacggaaaacctgacacccgttagtcgccctgtgctacggtgagaggctatgagcactattatcatgcacacctccgaaggtgatatcaagatcaatctgttcgacgagcagacaccgaagaccgtggagaacttcctcggcctggccagcggcaagaaggagtggaccgatccgttcaccggcaagccaagccatgaggccttctacgatggcctcaccttccaccgcatcatcaaggatttcatgatccagggcggttgcccgctgggcaccggcaccggcggcccgggctatgacttcgacgacgagatcgacccgtcgctcaagttcgacaagccgtatctgctggccatggccaacgccggcctgcgccgcggcgccgacggcaagatccacggcaccaatggctcgcagttcttcattaccaccgtgccgaccccgtggctcaacggccaccatacgatcttcggcgaggtcgccgatgaggcctcccgcgctgtggtcgccaccattgacggtgtggccacggatgcgcaggatcgcccgctcgagccggtcatgatcgagggcatcgagatcgtcgactgattcgacccacctgcatcccaatgggggcggccttccacgtggaaggccgcccccattgtcgtttcatctcatatggtgcatgccgtgggactagtcacggtaatggtccgcgcatccggcgcatgcgcggctcgctggagtcctttgcaccggtgatgcggtacacgtcgaagacgccgtcgatcttgcgcaccgccgacagcagcgtgttcaggtgccccgggtcggccatctcgaagctgaactggctcgttgccacacgatcggaaccagtggcgattgtgccggagagaatgttgacgccatggtcggaaagcacgcgggtcacatcgctcagcagatgaggccgatcgagcgcctccacctgaatcttcaccatgaacagacccttgttgctcgtccaggagacgtcaacgacacgttccggctcgcgtttcctcaggttgatcatgttcaggcaatctacgcgatgtactgagacaccctcgttgcgggtgatgaagccgatgatgttgtcgcccggcaccggcatgcagcaatgggcgagcttgacccacacgtcggtgacgcccttgacggcgattcccggggtgttgcccttcgatttcgaagcctgcgtgggccgcagcggcaagagttcctgctcggcctcctcggctacttcgttcgttcccgcgtccttgaccagatgggtgatcacattctgcgtggacacctgcccctcgcctatcgccgcgagcacggcgtcggcattcagcaggttgagatcgtcggccactcccacaagcgcctccggcgtgagcaatgcggaaaccggtaggttgcgcttgcgcatcgcacgtgtgagttcgtcgcgcccctcctcgatcgactcggagcgacgttccttactgaaccattggcgaatcttgttgcgcgccttcgggcttttgacgaagctcaaccaatcgcgggacgggccggcggtgtcggatttcgacgtgagcacctcgacggtgtcgccattctccagcttggtgtcgagggggaccaagcgcccgttcacacgcgcgcccatcgtgcggtgaccgacctcggtgtgcacgttgtatgcgaagtcgaccggtgtggcatcggcaggcagcgagacgatcttgcccttgggggtgaatacgtacacctcggcggaaccgaggtcgtctttgagggagccgaggaactcgctggaatccggggtctcgctcgtccagtcggcgagctgctggatccattgcagattgtccttctcctcgaggttcctgtccccgcgcttgagatcggacttatcgggggcgctcaacgcacggcccgcctgaccgttcgccttgtatttccaatgggcggcgatgccgaattcggcgcgccggtgcatgtcccacgtgcgaatctgaatctccaccggcttgccgccgggtcccatcaccgtcgtgtgcaggctctggtacatgttgagcttcggcatcgcgatgtagtccttgaaccggccgggaaccgggctccagcgtgcatgcacggcgccgagcacggcatagcagtcgcgaatcgaatcgacgatgatgcgcacgcccaccaaatcgtagatgtcggagaaatcatggccgcgcacaatcatcttctggtagatcgagaagtagtccttcgggcggccggtcacataggcgtcgatgtgcgcgtcgtcgagatcctcgtggatctcctcgatgatctgcttcaggtacacgtcgcgctgaccggcacggcgttcgacgagcacgacgatctcgttgtagatcttcggatagagcaccttgaagctcagttcctcgagctcagtcttgatggcgttcataccgaggcgattggcgagcggtgcatagacgtcaagtgtttcgcgggccttcttctgcgcgctggagggcttgacgtagcgccaggtgcgggcattgtgcacacggtcggcgagcttgacgacgagcacccgtacatcgcggctcatcgcgacgaccatcttgcggatcgtctcggcctgcgccgaatcgccataatccatcttcgtcagcttggtcacgccgtcgaccagaccggccactgtgtcgccgaactcggcgcggcactcatcgagggtatagtcggtgtcttccacggtatcgtggagcaatcccgcggcgacgacactaggacccatgccgaggtcggccagaatctgcgccactgccaacgggtgaatgatgtacggctcgccggaacgacggcgttgctcggcatgctggatcaccgcgcgggtgtaagcgcgtgacagaatctccatgtcctcatcgggatggtgctgtcggcacatcgcctcgatcggtgccagtgggtcaagtggattcgggctgatctcacagcccagcatgttggcggggcgcagatcctcttcatgctcgctcatcgctctcaaccctccttgctctcctccgatatggatttgagattagtcgttttgcctccgaaatgcacatcgcacatccatgcgtgaacaggcatggatgcgcgcgtcacactccgctcgagccgaacccacgctccgctcggtcggaacccggcaatacggacgcctcgatgaattcggcctgcacatagcgctgaatcaccagctgcgcaatacggtcgcccggttcgaacaccgcggtgtgttccggatcgagattgatcaacggcaccttgatctcaccgcgatatccggcatctatggtccccggcgcattgagcaccgtcaccccctgcttcacggccaatcccgatcgcgggtgcaccaggccgacatagccggcgggcaaggcgatgcgtacaccggttgggaccagtgcacgctggaagggtcccaattccacatgtgcagtcgtcacgagatccgcaccggcgtcccccgcatgcatgtaatgcaactccaccggctgtgccggattgaccggtgcgaccaatacctcggtgcgttccggctccacatatgcctcgtcgaacatcaggcggcgcattccttgcataccggctggccatcaggcgtggtgtacgccaactggctgcgatgcttcaccaggaaacattccgagcagatgaactcatcaccctgcatggggatcacggtgaccgaagcgtcctcattgctcagatccgcacccggcagctcgtaatcctcggcgatggcgttctcgtcgtcatccatgtcgttcgaggcattctgcgagctcttgccgagcgcctggagcgactcctcgtcctcgtccttgctacgcggggaatcatagtcctgtgccatgagaggattcctttcgttacgtgtttttacgtacccgtattaacgtgtaatactacgcaagtattccccgcataggatacacgatttggcaacaccgtaaaatccgacacgaggggcacaatgtaaatgttcacatttttcgatgacgacgaaggcgtgaaaatgggtactggctccttccccgcagcacaattcgaccatgtgacaccggacggtgacctggtgttcacggccgacggcatgccgttcctggtgcgtgtcgacgatacattcgaacgggccatgttggaggccaagcaaatccgttcagagaaacggatcaccaccgcggtgcaccagcagcgcacgctgcccatttcgcagatccaatcgctgatccgcgccggcgccgacccggagcacatcgctcggcagtatgagctgagcgaggtgattgtgcgcagattcgccacctcgatcgaagcggagaagaagtacgccatcgaacagttcctgcgtgtgcgcgcacccaaggaaagcaaggtgcgcacgctctccgagctcattgaccgcaccttggcggccgcacgggtgcgccccgaatcggtgcaatggaaggcgacgcggcggggtctggaaccgtggcgcatcagcgccaccttcatctcggcggggcatcggatccacgccgaatggtcgtggaacatgcacgacaacaccgtggtgtgcatcaacaacgccgcgagcaagctgatcggcgagatgggatctgtcacaggcgcctcgttcgacgatgcgggaactcagaccgccctcgacgaggccctcccctcatccgtcgacctgccaggtgattcggcgcgttcggcgcgcatcgaacagaccatgcgagcatggaatgggtcgggaaacgaggaaccttccaacgaacaggagacgctgacgaccaatgagaccgaggcccgcaccgcaaccgataccgcacgggccgcggacgcatacgcccatgccaccatggacgccatgccggaagacgccggcacgacacctgccgaggaagcctcgcagtctgaatctgcaccatccgcggtcgaagagccggtgcagaagggcaccgacacctccagccagtctgactccccacattccgacgatgcacctgagcccgctccatcccaagaacacagacccgacgaaccgtcacagctgcgcaaacgtgtgccgatcagcgcactgtaccccaagcagaaggctccagcgcaattcactccgaagaacaccggggcccagcgtcctgccatcaagccggatgccgtgcaaagccagccggagcagcatggcgacgacgacacccccacccagcaacagccacaggtccacaggaacacctcggagcagcattcgccgcaccgatcgaaccgggcatcgatgccaagctgggacgagatcatgttcggcaaggatccgcataaacacgactgaatatgtcggattcagtcgacgagatcgatgaggcagggcacatccatctccatcatcgtctgcgatccatgcacgccgggcatgcgggtggctccttcggtttgcgagcgcgtgtccacgatcgtgttctctctggcggcatagacgaacacatcgccgagcatctcaggaacgtcgggccgcattggtccgagcaaaccgcaatcaatcacctgctgtttcgtgcggatccacgcacggtcccccagtcgcgcacgccaacgttcggctatgctctcggcatccacgccatcctgggcatacagcatcgtggcgcggggttcgcctcccaccagtctcacgccctgctggagcaccggatccaaggccatgtctatacgcgcctcgtcgccttggtccgcggtcgccatgccatggtcggcgatgaccacaatgagcgtgcccttcgggacttgcctgtgcaactgccccaatcgcatgtcgacccgctcgagggccacctgccattcgtcgctgtgccaaccgtatgcgtggccagccttgtctatctcgcgcatgtacaggtaggtgagcccgggttccttggcggtgtcggcggcgatgcgcacgcgtttgttcgcatcgtcatggccaatgtaatcggagccgcacaacgccgcacgggtcagcggggacgccatgaatctggtcagccccacgctggtggcgcggttgccggcatcgctgatgagcgagaacacagtgggttccgtctgcagttcttcgggatgtatggcaccacggaactggatgagttgactcaacgcgccggtgcggggattgagctgcgtgtagccggccatgcctgtcaatcctgggcaggtgccggtgccgaaggtggccatggccgccgtggtggtgcttggcgagcatgtgctgatcggacgttggttgagcggttcgttcatgagtgagcgcatatagggcgcgtaaccgagcttcatgttgagattccagtaccccagtccatccacgagcaccacaattgctgatttggcgcgcggcatgccgagccgttggcgcaagccctcggcgtcgacgtgcacatcggtgcgcaccggtgtgccgatggccgcactgagtgccggcagcaccgcggagatgtgcagcgcgcctccacgggctccctgctgtgcattcccgagaccagccggcacatcgctcggccggtcggcgtcaatctcatcgccgtactgtgctgtgggaacaaagccgaggagtgtgccggaatctggaatatctacgctcatactgctattcaagcgcggttgatggactcgtgggcacgcgtggcggaactcatttcaccacatgggtctttcggcgcggacggggtagaatgggacggttcattggataagggagagcaaatatgacgcgtcgcaggcaggcagcggccgggtacgacccccggcaggtcgaggagcacatcgtggagaccccgctcgccgaggagatgagcaaatcgttcctggaatatgcctactcggtgatctacgcgcgcgcgttgccggatgcacgcgacggcatgaagccggtgcaacgccgcatcgtgtaccagatgggtcagatgaacctgctgcccacgcgcccgtacatgaagtccgcccgcgtggtgggcgaggtgatgggcaaattgcacccccatggagattcggcgatctacgaagccatggtgcgtctcgcgcagccattcgcgatgcggctgccgttggtcgacggccacggtaatttcggttcgttggacgacggtcctgcggcatcgcgatacaccgaggcacgccttgcacccgccgcgctcggcatgaacgccgacatcgacgaggacacggtcgatttcgtgccgaattacgacaacaagctcaaggaaccgaccgtgctgccgtcggcgattcctaacctgctcgtcaacggcgcctcgggcattgccgtcggcatggccacgaatatggccacgcataacctcggcgaagttgtcgccgcagccaaatacgtgatgaagcatcccgatgccacactcgacgacctcatgcaatacgtgcccggacctgattggccgggcggagggatcatcatagggcgacaaggcatccgagatgcctatgagactggccgaggcgtggtcaccacccgttccgccacacatgtggagaatctcaccgcacgcaagaaggccatcgtagtgacgcagctgccatacatggtgggtcccgagcgtgtgctcgaacgcatctccgagggtgtgaagaaccataagctcgacggcatctccggtgccatcgacctgacggaccgtcacaatggcacccgcatcgtgatcgagctcaagacgggattcgacccggcagccgtgttggcacagctcttcaaacacaccccgttgcaagagaacttcgccatcaacaatgtcgccttggtgaatgggcgcccccacacactcggactgcgttccctgctcgatgtatggatcgaacaccggcgtggtgtcatccggcgccgcagtgagttccgccgtcagaaggcgttggaccggctgcatctggtcgagggtctattgctcgccttggtggacatcgacgaggtgatccgcgtgatccgctcaagcgacgatgcggaggcggccaagaacggactcatgagccgattcagccttgacgatattcaggcgcaatacattctcgacctgcgcctgcgcagactcaccaagatgagccgcatcgaactcgaatccgaacgcgacgaacttcagtcgtcgatcaccgaattggagcgcatcctcggctcggccgcattactggatggcgtggtgatcgacgagatggacaaggcggtggcaacctacggcacgccacgacggacggtgctgctcgatgagggcgacgacggccggctcgtgccagtcgtggcccacggcgatgacatgccttccgacgccgcactcgatgccgcacgccatgcggagaacgtactcgacgccgccgatgcggtggcggcagcccgtaaggccggcgaaaccgccgaggcgctgcggatagaagacgaaccatgcgtgatcgcattgagcgcctcagggctcatagcccgcatgagcatcgatgccctgaccatttgggccaaacgaggcgctcacaccgaaaagcgtgaacccgacgatgtgatcgtctcgctgatgccggcacgcacccgtgccgactatgcgttggtcacctccgcgggccgcatggtgctcgcccatgtggtggagctgccgaatctggaggtcaccggccacctgagcctcacaggaggcattgaagccaccgagctgctcacctccaccgaaagcaccgatccggtgcccggcgaacgggtgatcgccacgctcgcgctacgcgacaccgtcgggcaggacgatacggcggcacagctgccgccggtcgggttaggcacacgcaacggcattgtgaagcgctggaaccgtgaatcccccaccacgatggattcctggagcatcatcgatttgaaggacggggacgagctgcttgtggcggccgatgcgcatgacgacgaccgcttcgtgttcgtttcctccgattcctcgctgctcacgtatgaggccaggaatgtacgtccccagggccgcactgcggcaggcatggccggcatacatctcgccgatggatgtacggtgctctcctgcgccgtggttgcgcacgccgatgtcgaatggcatgatgccgagcacgatgacgcaggcaatctgctctctcccgccagtggagccgtggtgctcactgtcgccggcgatgtggatgcgctgccgggcaccgagaacggtgcggcgaaggtcacgccattggagctctaccccaccaagggaagagcgaccggtggtgtgcgctcgcagcgcttcctcaaggggcagaacacgttgatcagggcgtgcgtgggttcctacccgctgctggccgcaacgtcggggggccatcccgtcgagctgccggcgccggatatgcgtcgtgatggttcgggaaccgagctgcctgcaccgatcgcctacgcggcctaagtgagatcgcagagtcggtatacgacaggcctcggtcagagtagctctgaccgaggcctgtcgtataccgacttcatacctatcacgtggtggtgtacatcgccataagcaccgcacctgccacgatgagcaatgtgccgaagagtatgcagatcatctgatgtcttgtcttgtgttccttgaggatcacgatgccaccgaaggtggagacgagcactcccagttgggagaaggtcgtggcgatggcctgaccgacattcgggttggctgccgagatgaagatgaggcagttgcctatggcccaggagaggccagtgaagatgttcagcgcggtcttgcgggtgaagatgagcgactggttgtgctcgccaagcacaatgatggcgactgcagcgagcacctgcccaaccgactgcggcaggatcattgcggtcatataatacaggccgttaccgtccggcgcattgtagatagcgttgtcgatatacccggtcttgtgcagaaggttcgggaacacgaagtacatcatgaacccgatggtggagatgagcagggcgatcatgccgaatttcatgttcttcgcactgatatgcacggcatcggtgacggaatctctggccgaacacagtatggcgccggaggtgacgagaatgatggcgatgatcccgatcacccagactcgcaatgagcgccactcccccaaaacgatggcggccatgagcgcattgcccaccacctgacgggccgtggagatcggcatcgccaaagagacgccgagcggtttcaaggccgagaactggccgatggatcctatcgtccagaatatgccggagcataggcccaccacccagatgcggggattgaacgcgaacgatgcccctgcatggggaatcgtgtagcacacggccatcagcaccgcgaagaggaatgcgccgaaggtggtgcccagcgtcccctgacttggcttgccgtcgatcttcgccgtcatcacactgttcgagccgaggaacaatgccggcaacaacgcaatgagcatgcccatgtgaagtcctttccctgtacaatgccaaatcgttgtacgcagaacgcaaaacacaagcattctaggacctccaccgctacgttcggaccgctcttccgctcatagcgaggaggctgcccgccatacccgcctcatcgatacagtcggagcccctgcggcgacggggtgaatccggcatgccgaagggcgtcggacatcgcgttgccgccctgcaatggcacgccgttgcaatcacggaaagtgatgctggccccatgcaatcgcgaacatgtctgttccaaagccgtcgccgccgttttaagcacgctcggcgaaggctcgaacgccacgatacgacccgaccacagtgccgcatacagcaccgcgcgcccctgacgcagcaccaccaatgagcccgggcgtcgtattggtttcacggcagcgcgccgtttggagtccgtgcgggcattggattcaagtatggccggcgccggccattccaatgacgaaccatagagattcgccggatcgcatacatccatggtgacggtcatgacaggctcggaatcgatatggtgacgcagcaggtccaccgtctcccgctcggcgaattgagcggcaccgaaccccttgacgaatacacctcgcaatagcgtgcctttctcctccatgcgtttgagcaccggataaatggcactgaatccgccggcgacaccggcatctgacaccgtattgggcgcaatgatgccgtagcggtcgagcagaatacctatcaggtcgatcatcgcctcctcatggctcgcatcgccttgggtgcgcaccagtgaccacagaccgccgccgaacataccgcgtgtgggtattcgggcacgcaagcggagacgatgcgaccgcaccgtggccttacttccacccgtatgcgttgacaccgaccggactggttgcagggaggtgttggtaatgaatccatgccagaccaatgaccatagggtctgctcgaatcgcgaatgggaccatgatgtggccatcacctcgccggtcgtctcattcacctccggctccggattcgcctgccacagggattgcgcacgctcctccaatgagtgcgccgtgtaagcgccaccgtcgtgcagggcaagcagtatcgcatcgcgcaccgtcagcggcatgtcggattccggcgcagccgctcgacctagggaggattccaatgcctcagcatgcacctgcaactgtggggagtccgccgggaagaacatgacgcgtcccgcctcgtcacccccttcgccgctgcccgtgggatcacccacccataccacatcgccggagccaaccagctcgtcgagcaatgtcggcgtgtaatctcgcacacgggccgggaacacgtggcgctcccacacgggcatcggcaatgcgacaccctccagctgttcaatggcacgcaagagtccatccagaccttgcaaccgttcgccgcccaccgagccgacaccctgccgatgaacgagaaacgcctcgtaccgctcgggttccacaggtttgattgccgcccgggccttggccaacgactgcgagcgaatgcgtttgagcacgtcggcatgcacccattgcgtcacccccggagcgagtcgttcgtcgaaacgaccgttgatgagctcgccggcatcgcgcagttcaccaagcagttcgacggccgtctgcgcgtcgatctcaagttcggagagcaggcgatcggcagtgaacggtccatgcgtcttggcgtagcgattcacgcgtccccgcagatcgtgcttgtcgagttcgttccagaaggtcttcgaagccagctggccggccactgaatcgatcacctgtgtatcgagcacctgggccaggttgtccgtccccaacaaccgttccagcaccagcggatccatcgagagcagttgcgcattgcgttcggcctgcggcacatcgtactggtacatcaccgaccccacgaaaccgaacagaagatgctcggccataggcgatggcacttgcgtctcgcatgcatgcacgtcgatggctcccccacgtatgcgggtgagcacttcgcggagggcaggaacgtcgtagacgtcctgcagacattcgcgggcggtctcgagcagcagcgggaagttcttcctcgtgcgcgccgcggccagcagctgggtggccctcagcctctgctgccatagaggcactcgtttgcccgggtcgttcctcggcatgaacagcgcacgcgccgcgacctcacggaatcgggcggcgaacagcacactgccggagacctggttctccacgatgcgctgaatgtcatcggggtcgaagtcgatgagcgcgccgacgtcgatgcctccttccccatcgggcagacgcagcacgatgccatcgtcggcggcgaagatctgcccgtcgaaaccataacgctgcgtcaacctcatgttgattgcgagcgcccatggctcatgcacacgacgcccgaacggcgtatgaatgatcacgagccaatcgccctcctcctcgcggcagcgttcgaccacaaccgcacgaccgctcgggatcacaccggtgctcgcccgctgctcggagaggaaggccgccagattctccatagcgttggcgtccagaccatcggctcgcaggcgtttgagaaccacgtcgctgaatcgggattccggcgcgttcccgacattgccgtgcgccggttgcaatcccgcggcgatgtcatgcacccattccccaagcgacatgccgaaggaataatcgcgcccgttgccctccccatgccagaacggcaggcgtgcccttcgtccgggcgccggcaccacgaccacgcgggagttcgtgatttcctgcacctgccaattcgtggtgccgagtgtgatgatgtcacccacccgtgtctcatacaccatctcctcgtcgagctcaccaacccgtctcggacctgttcccgcctcggcctcgggcagcactacagtgtagagaccgcggtcgggaatcgtgccgccgctggtcaccgcgaggcgctgtgcacccggacgcgccgagatcatggccgaatcctcgtcgaacatgagcggtggtcgaaatgccgagaagtcctcggaattataggcgccggtgagcatgcccaccacggcgtcgaacatcgcccggtccaacgaggcgaagggggcggcgcgtctcaccgtcgcataccaatcatcggcggcgatgggctccagactggcggccgccacggtctgctgcgcgagcacgtccaaaggattcattggcatatgcaatggttcaatcgccccgttgagcatgccttccacactggcacctatgccgatgatctgttcgcgtgtcaccgggtacatgacggcgtgcgagactccccccaccctatggtcggctcggcccacgcgctgcaggccagaggagaccgacaacggcggcgtcacctgaatcaccagatccaccgaccccatgtcaatgccgagctccagactgctcgtcgccaccacacaacgcagacgtccggatttgagtctctcctctatttgcttgcggcggtctttcgacaccgacccgtgatgcgccatggcaatctgctcgtcagggccgtgcgcccccactttcattgtggtggacccatacgtggaatgatagtgggctggctcgtccgtctcgctggtcggcagttccaccggattgcgtttgccgagccgttgtgcgtgcagatcgttgatctgcgcggtcaggcgttcgcataggccgcgcgaattcacaaacaccaatgtggtgcggtgcgagagtatctcgtcgagaatatggcgttggatcgccggccacgcggatttcacccccgacggattgtgcgcgccttcgctcaccggcgtacccggcggcagcgaatccccccatcgcttggttgtctcgccggtggttgcagattgcggatcgccttggccatcccgttccctcgccttgcgctccgccaagcgttgcatcgcgggcgtcacgccggtcattggcgcagaagtgctgccgacctccccagcaccccccttgcgcctgccattggccacgggcccgtcaccaagggtcttcgccggttcgaccacagtgatgtcgagtgcaggctttcccccggtggcgatgaccgtcaccggcaatgctcctgcgaggaacttcgcggcacgctcaggcgggttcaccgtcgccgaaagccctatgcgctgtgccggccgttccagaaggtcatcgagacgctcaaggctcagcgccagatgcgccccccgtttcgtgccggcgaccgcatgcacctcatccacgatcacggtatccaccgttttcaggatgccgcgcgctttcgaagtgagcatgagatacagcgactccggggtcgtgaccagaatgtccggcggatgcgacatgatcgcacgtcgctccttcggggtcgtatctccacttctggtggcgacggtgacctgcggcgcatgcgagccaagggcatcgatctgttcgcgaataccggccaaagggacatcaaggttcttcgccacgtcgacgccaagcgccttcaacggtgagatatacaacacgcgcacgcctttgcgtgcatggtcggcggcactgcgggacagaagcgagtcgatggcgaacaggaacgcggagagggtctttcccgaaccggtcggcgcgatgaccagcacattctcgcgtcgcccgatcgccggccatgccaatcgctgcgcctcggtgggttctccgaacacacgtgagaaccacacgcgtgtgggttcgctgaacattgccatacattcgcacatatgttcgattatttcctacctcgctcgcgattgcaaatgtgacacgctcatgagaatgacggcggccagtatgccaagcgacgtgaaacacgccaagtaccacggcagggccgccatgcccaccgtggcagagaacacggcgaacaatacgggactcaccagtgtggccacggcgatgacggcggtctcccagccgatcatggtcatcgtatgaacagcgccgaacagccgtggtgtcatatgcacgacggccggattaatcggggcacacccaaacccgagcatgaccggcgcgacgagggcgcgccatgaccccatgggcacaatcatcaccacaagcgccgcaacaagtacgcccaagccgccgccgagcaacgcgccgtcggacaatcgcagcgccaagcatcctgcgatcacggaacccagcgtcaatccaatgaagaataggttcgcgtagataccggcataatggatgctcatgtggccggcatgcaccatgtagctgctcgcccacagcatggtgctctgctccaccgaagcgtaggcgaacagaagcaacagtgtcgggaacgcgccgcgcaatctcagggctcgcacccagacggccatgcgtatgcgcgtcgacatgccaatcacgctcgccatatgcctgcatgccgaatgtggcgcgctggatgggggtcagttcgtcgcgccacagcttcgtggcactcaccaacacgatggccagcgcaagttgcacaaggcctatgcagcggtatgcccacctccagtcggcatcgttcgcaatgatccaaccgagcatcgtatgacctgccatggcacctgcggccgtcgtggcgtgcatccaaataatatgcgcactcggcaagcgcaatgctatgtatgcgttgagcgcgagcgcaagcaggccggagcccacgccatatggcacggcgaagaacagcagcagccaatatgacggcgtgaacgagaagccaagcaatgccaccacggtgcatgccacaccaacatccacactgcgccccgagccccagcgacgcagccaaggctcaccggccagcgcagcccacatggcccctgcggcgataacgacggggatcccgatgacggcggcaagtgacgcatgcagtcccgaccccatagccggccacgaggcaccgagcggggcctccggcaaccccatggcagcgaagccaacgtataccaacgccaccaacgccatcggcatgccatcgccccctcattcagacgtcgtcggctcggattacatgctgcatatatttgcctatacagtgcatacacggtcatcgtaaggcgcatcgacggcgcatatggcacggcatcgcctgttacgaacatgtcagacggccatgtcgtcgcgtcgcaatgcgcgcagccactcgtgcatcgccgccatgaacgcgacgaacaccagcagacaccatggcagcacggcaatcgtcgtggcctgcgcgatcacgccgaacaatggtggcatgagcatggtgcccacatacgcgaacgccatctgcacaccgacgatcgcctgcgatttatcggccccgaagtatgtgggcgtggagtggatgatgcacggatagaccggagcgcatccaaggccgacgagtatgaacgccacggcggagagggcggggttgtgcacgggaacgagcaacaggagcgccccgaggccgatcgtcatggtgccgatgcgaatcatggcgggatcggagaagcgcatggtgaggaagccgttggcgaatcggccaacggtgatgccgatgaggaagatgctcgtgaacgtcgcagccacgtcttcggccatgccatccatgccgaccatgtaggagctggcccatagcatggcggtctgttcgatggcgcagtagcaaaagaacatgatgagaatctgcgtggcgccactgatgcgcaatacaccgagcaggccgattggctttcggtccgtggcctgcgtgcctgcgtccgcggcagcggggcgcctcttccacaacggcaggctgaagatgagcacggcggtgagcacgagctggataacaccaaccgaacggtagccccactgccaaccatgccggcttgccatggcgtaactcatcatgtacggtccgatgagcgcgccgagcccccacatgcagtgcagccagctcatatgccggctcgtgtagtggatggccacgtagttgttgagcgccgcatccacgccacccgcgccgagcccgtagggaatggcgcacacgataagaacccagtagttcggtgcgaaggagaatcccatgagggcggccgcagtgagcgccacggagaacgccgtcacacgccctgcaccaaatctcagcgtgagccggtcgctcagcagtgcggagatgatggttccggcactgatcgtcatcgagatgccaccggccctcgacagtggagcatgcaggtcaccgctcatggtgggccatgccgaaccgagcagtccgtctggcagccccagcgagatgaaggccaagtagattacggcgagcagcagattcgtcattgcacctccaaatagtgtgcgccagtttctgcatcgacagcccataattatcttcttacgtaaagaaaatatccggttcttcgaaatctgttcgatgattagactggtgcccatgagcttgagaatcggattcgtgttcgacgacaccctggacgtgctcgacggcgtgcagcagcatatcgtgaccttgggccaggagctggcgcgacgggggcatgaggtgcattatctggtcggcgagacgcatgactcccccgtgccgaacacgcatccgatgtcacgcaacgtcatggtccggttcaacggaaaccgcatgcgcatcccgcttccggccaacacacggcatatccgcgaggtgctcgacgaatacgatttcgacattctgcacgttcaggcgccctacagcccgttcatggcagccagggtgctcgaccatgcgcaccagcgcactggcgtcgtcgccacctaccacatcgcatcggccgaccttgcctcccggatcggcggccgtgcgctcgggctggtcaatatgcactcccaccgccgcgtcgacgaggtgatcgcagtctcccagatcgccgcgcagtatgccgagcagaccgcgcatgttcgcggtgtcgtcattccgaatcccgtcgatgtcgatcggttcgcaggcgcctcccccacccatgccattgtgcagggcgacacggccagtgcgcactcgtccgagggacccctcgcggtgttccttggtagattcgttccgagaaaaggcgcggaattgcttctggatgccgtcgaatacggcgaggagcatgatctgttcccgcggggcttccatgtgcggttcgccggcaagggcccgctgctcgacgaatgccgggaacgtgcctcgcatctgcgcacgccgatcgagttcctcggcttcgtggaggaagaggagaagccgaagctgctggcgagcgccgatgtggccatcttccccgcaaccggaggcgaatccttcggcatcgtgctgctcgaggccatcgcctcgaatgccggtgtcacgctggccggtgacaatcccggctaccggtcgaccatgctcgatgacgaggactcgctcttcccggtgagtggaacagaccgtgcccgcattcttgccgaacgcattgcccgcgcactcaccgacgaaccttgggcggccgacctgcatgcccgcgaagcggggctactcgatcggtataacgttcgcaccgtgaccgatcaggtggaacaggtctacggccaggcgatggcggctcgccacgccgactgacccatatcgtgcgagaccgatgcccacaggggcccggaacccgcgcttcgtcaaagtgtctgcgcgctttgcgcgtagagcacgctcctcagcgcgggttccgggcccctgtgggcatcggttgcacgaaagcgtcaggtgtcaatcttcgaacggtcgaaatcctcggcgttgtcgacaatgaactggcggcgcggaggcacttcgtcgcccatgagcaggctgaagatgtcgttcgcctgctcggcgtcctccatgcggatgcgacgcagcagacgcgtgcgcggatccatcgtcgtgtcggcaagctggttcgcgtccatctcacctaagcccttgtagcgctggatgtcgtcggcatacggaatatgctcagcgtcgagctgcgcgagcctgcccgccaactcgtcatctgaatacgtgtagatgtactcgcccttgcgtgcccccgccaaagcgatgcggtgcagcggcggcacggccgcatacacgtgccccgcctcgacgagcggtctcatgtaccggtagaacagcgtgagcagcaatgtgcgaatatgcgcgccatccacatcggcatcggtcatcatgacgattttgttgtaccgcgccgactcgatgtcgaagctggcccccgaacccgcaccgatcacctggatgatcgacgcgcattccttgttcgaaagcatctgcgacaacgacgccttctgcacgttgagaatcttgccgcggatcggcagcagcgcctggaacgccgaattgcgggcggccttcgccgtgccgagtgcggaatcaccctcgacgatgaacagttcggcgatgtcgtcgttgcccggctggcaatccgacagtttactcggcatagaagcagattcgagtgcgttcttgcgacgtgtgacctccttggtcttgcgtgcctgaatgcgcgcgtgcatctcgcccacgatcttctcgagcacgcgcgccgactgctccttgtacccgcgtttcgcgccggtgatgagctcggcgaactgcttgtcggtgatgcgtgtgacaagcggcttgaccggcgcggtgccgagcacgtccttcgtctgcccctggaactgcggctcggcgatgcgcacggtgaccacggccaccaatccggcgagaatgtcgtcacgctcgatcttcatcttcgggtctttgagattgaccttgagcttgcgcgcgttgtcttccaccgtcttgcgaatctgcttagtgataccctgcaggaagccgtccacatgcatgccgccgcccggcgtggcgacgacgttcacgaagctcttcaacaccgtgtcgtagccgttcgtccaacgcatcgcgatatcgacatcgcaggttcgcacgatcttctgcgcatgcaggtcgccgttcgcgtccactgcctgcgtctcctcatggtacgtgccctgcccgcttattcgccacacggtggaaacggcctcgccgtgggagaggaagtccacgaaatcgacaatgccaccggtatggcagaattcctccacacgccggtgtcccggcactgaggcgcccgaatccgcagattgcacgaccggtatggctgcgactgcctgctgcgggtcctgtgcctgttcctgcgcgtcctccgcattcgcccgctcaaggccgatcttcgcaggattctcgcttgcctcggtctccgcctcgatccgctcgaccgggtcggattgcgcctgtttgacgtcggtctcctcgaacacgtcggtgtcgacgtcgcctgtctcacggatgcgttcgtcgatcaccgtgatcttcagacccggcaccaggaagctcgtctggcgcacacggtcaatcagttgttcgtagtcgaatttcgcggtgtcattgaagatttccggatccgcccaatagcggatgcgcgtgcccgtgcgcttcgggggcaccttgccgatgatctcgagctctgtggggcggttcttgcgcgttttcttgaacggtgagtcgggggaaggacgctgtgggtcctcgtcggtatacacacctggatgcccttggtggaacgccatatggtaggtgtggccgttgcggtcgacttcgacgtccatgcgcgagctcaatgcattgaccaccgacgagcccacgccatgcagacctccggcagcgttgtacgacgaattgccaaacttggcacccgcatgcagcttggtgagcaccacctcgacaccggtgagcttcgtcttcggctccacatccaccggtatgcctcggccgttgtcggcgacttcgatcgaaccgtcttcgtgcagggtgacgacaatatgcgtgcatgccccggcgagcgcctcgtccaccgaattgtcgatgatctcccacaggcagtgcatgagaccctggctgtcggtggtgccgatgtacatgcccggacgcttgcgcaccgcgtccagcccttccagcaccgtcaatgagccggcgccgtagctgccgggttccttcttcgccataaccctcctccgtatctcctcttcgatgcaaaagagagcggagccactcggctcacgctctccctggcactgtcatgtcgtctggcgtcggcacgcacccatcggggtgcgccggcaatggacgccgttcagcgtcactgatcgaggaagtcgcgcagcgtctgcgaacgggacggatgacgcaacttcgacatggtcttcgactcaatctggcgaatgcgctcgcgggtcacgccatatacgcggccgatgtcgtcgagcgtcttcggctggccgtcctcgagaccatagcgcatcttgatcacgcccgcctcacgcggcgagagcgtttcaagcacctgacggaattgctcctgtagcagtgagaatgcgaccgcctccgatggcgcgatggcatcggtgtcttcgatcagatcgccgaattcggaatcgccgtcctcacccagcggcgtatgcaacgaaatcggctcgcggccgtacttctgcacttcctgcaccttctccaccggcatgtcgagctcgcgggcaagctcgtcgggcgtgggctcacggcccagatcctgcagcatctggcgctggacgcgcgagagtttgttgatcacctcgaccatatgcaccggcacacgaatcgtgcgggcctggtcggccatggcgcgggtgatcgcctgacggatccaccaggtggcataggtggagaacttgaagcctttcttccaatcgaatttctcgacggcgcgaatgagacccagattgccttcctggataaggtcgaggaatagcatgccgcggccggtgtaacgcttggcaagcgagacgacgagtcgcagattggcctcgagcaggtggtccttcgccttcttgccgtcggcggctgcccacttgagttcgcgtttgcgtctgaactccatcgtgtcgccctcggtgtcgagcagatgctgggcgtacaggccggcctcgatacgctcggagaggtcgacctcctgttcggcattgagaaggctcacacgaccgatctgcttgagataatccttcaccgggtcggcggtcgcgcccgtggttaccacgcggcgcttcggattcacgcccggattcgccagaagggcttcgtcgtcctcatcgttgtcgctgacgacgaacgcacccttctccttgggctccttcggggcctgcggctcttcgtcgtcgtcttcctccggctcgggttcgtcctccgactcctcgtcctcgaggtcgtcatcgttctcgtcggcgtcaagatcctcatcgaggtcaagatcctcctcgtcgatcacatcctcaccgatcatgtcctcgtcgtcgatctcctcggacttggaaatggccttcttcgcgccggtcttcgaagccgcacgagtcttccttgccggcgttgactcgctctcggcggcatccttcttcttccgggccgtggcacgcttggtggtcttgccggcggagcccttcttcgccgacgaagccttcgaggaggccctcctacgggtggtcttgcccttctcttcgacggcggcttcgtcgtgggcgctttcggaggccttcttcttcgcggctttctcggtgctcgtcgtttccttggcgaccaaactgtacctccctgggtcttgtggaacgcggccgaccgtcgtatgcttgcttttgggcatagctacggcaaggtcaagtcgctgactatgtgagttaaccatgtcttcgggacgattattcccatagaccctcaggtgcctgcaatcggtgcgtcctccgtctcggcgcggcctgcatgtgccgggtagacgtgtcgggtgaccgcagccgcgacgatagccgccaatgtgacccgttcatcctcctcgagcaccccgagcgcatcgtgcagcgcggactcgtcgccacgccaccatttaagataggccctcaccgcccgcaattgcctggtgcattcggcgggaagacgccccgacatcgtgtgaagcagttcgacgacccgcacgcaccgccgttcgtccgattcgggttcctcgaaggccgcggtaagcatggcggacatagattgtgccacatctttgtcatggggatgcgcggcgaaccgtgagatgacgccttcgtcccactgcgactcgtccgccaccactgtcatgatgatcgcatcgcgcaccgccaacgagatgttgaaaccggtgaccaacatcaactgcacctcatcatcgagatcctgcggcttcatttcaggctcccgcagccacgtcagccatggaggcagcagatcggcgatccaccgggccgccgccgatgccgtaccgatgtcggtcatccgctcgaaatactcgcggcgcatacccccgagccgcgccaccggcaatgggtgcatgcccagacccgcgataccgccgtcttcccggttcatctccgcttcctcgttgtgttcattgttcgacaccatatctactccttgtccgtcttgcattgcgacccaaacgggccttgcatccactgtggcggcagaatggaaaggattccatcccaacgggcatttgtggtcggagaacgtgttatccacattgcaggtcgggcatattgtgcatgacctgcaatgtcggaatgctgtgaatacactggaaccatgagcgattccagcagtatcggcgccattgaaacccgcattcgagaacttgtgcacgactacgtgggggtgaacggcacagatgcacccatcaccccggctctgcgcccgatgttccatacagtggtggatcaggcgctcgcctcaagcgaagggggcaaacgcctgcgcgcgctactcacactggatgcctacgatgtgctggccggcgccccggattccacacaatcgcgaagcgtgcgcaccaaggtgcttgacttcgcctgtgccattgaggtgttccagaccgccgcactggtgcacgacgacctcattgacgactcggatctacgccgcggcaagccctccgcgcactgcgcgctcacctcgttcgccggcgcacgcagcattggccgcgggctgggcctcatgctgggcgacatgctcgccacggcatgcacgctcatcatggaggacgccagcaccggtatggtcgaacatcgacgcttggtggaggcctttctttcgatgcaacatgacgtggaggtgggccaggtgctcgaccttgccattgagcgcatgccactcgacgatccgcaagcgcttgccgaagcgtcgctcgacgtgtttcgctggaaaaccgccagctataccaccattgccccgttgatgctggcattcctggcatccggtatgaccagcgaggcagccaacctccactgccatgccatagggctgccattggggcaggcattccagctggccgatgatctgcttgacgtcactggctcctcccgcagcacgggaaaacctgtcggaggtgatattcgtgaggggaaacgcacggtgttgctcgccgacgccatgatgttgggcaccgccgcacaacgcgtacagctgcagcagctgtacgagcagccgttccgctccgacgcgcaggtgcatgagaccattgcgctgttccatgacaccggggccatcgagcattcgcacgaacgtatcgcgaagctgtggtcgcaaacccaggaaagtatcgaagcaatgggtctcaccgccgcacaatcgcaaagccttcgtaaagcctgtgagcgctttctgccggatttcacagccgaacggtaaaatatcctccgaaggcacactcgcaatcggggcatcacagcagaaggaacacaaccagcatggtggataccacggcacacggcacggaccactacaatctcattgacggccgctaccgcattgtgcgcaagatcgcggatggcggcatggccacggtgtaccagaccgtcgacgaaaggctcgggcgcaatgtggcggtcaaaatcatgcacatgcagctggcccagggcccccaccgcgagcagttcatcgagcgcttccgacgggaggccaaatccgcggcagcaatagccaatccgcatgtggtgcaggtgtacgacaccggtgagacgaatggctcgtactatctggtcatggagtatgtgcacggcgtgaatctgcgtagtcagatgcagacgcacaccacgttctcggtgcgcgacaccctgcgcatcgtcggcgagacattgaacggacttgccgccgcccacgagatcggcgtcgtacaccgcgacatcaagccggagaacattctgatcaacgaccgcggtcatgtggagatcaccgatttcggcctagccaaggccgcctcgcaggccacgctctcctccaccgggatgctgcttggcacagcggcctatctcgccccggagatgatcgaaaacaaccaggccactcctcagggcgactgctattccgtgggcatcatggcatgggagctgctggcggggagggtgccgttccagtcagacaatccggtgacgatggtgttcaggcacgtcaacgagaacatcccctccataggaacggtgtgctacggcatcgacccccgggtttcggccttcatctcgtacctgaccgcacgtgacgtcaatgcccgtccgaaaagcgcacagaaggcgttggatcgcctccgtgagctcatgcccacgctgagccgccaggcattggactatcgcttccgcccccaggaaccacccatcaacagcactcgggtgttcccaatgggtgcgaatgagcaggattccgaccgtccctccgtttcgagcaaatcggattcgccggaagaatccactccaccacctacctctgccgccgcgcttttcactgcattggcctcccccgatctcactgaagaggaggcggaacaggcaagaacggtagctctcgccacaccgccggacgactcctcgacgccaggctctggggttccggcctccggtggaaccaccgttccaccatatggaggctctaccggaagttatgggcgtaattccggccgtcccggcgagccaggtgcgccattgcccagcaatgcccagacgcaagtgcagcctcgcaagaagcatagaacggcgatgatcgtttcgatcatcgccgccatactcgcattgggtgccggtggcggattcgcattgtggtacttcgtggggcctggcagctactggacactgcccaaacccgaggggctcagttgtgccgaaaatgcgccatgcaagatcacaggtgtgaaatgggatgcctatgagcgtctgctcaaagtctcgcagattccgtacaaaagcacacagcagtatagcgacacagtgcctgccggcgagatcatctccaccgacccgcaatttgtggatgcccatgtgagcaagcgggccagcggcgaggtgcatgtgacggtgtcgcaaggtgtgcagcaggccaccgttcccgaaggcatcatgagcagctcgtcccctctggacgacctgcggaaggcgggcttcaccaacatcacgcacagcgaagacaacgacgagtattccgaaagcgttccggaaggcgaggtcatcgacatcacgcccagcgccggcaccacacagaaccataacgacgacgtcgtggtgacgctctccaaagggcccatgccggtggcaatgccgaatgtggtgggcatgacgcgcggtcaggcgcagaagtcgtttgatgacgccaagctcaaggcgacctacaccgaagagtacagcgatacgattccacgggaccaggtgatttcagtggatcccgaggcgggaacccaattgcactggggcgatgcggtcacagtcaccgtctcgaagggccctgaaatggtgaccgttcccgacatcacgggcaagaagacggaggaggccaggaagatccttgaagacctcggctttgaggtgaaggtctcatcaccgttgggcgacctcctgcacaccgtgcgattccaagatcccaaaggcggccagcaggtgcgtctgcgtggcgaagacggcaagaaaacggtgatcacactcacggtgatctgagcggcgtatgcgcgtatacattgtgtcccagagccagactcaggtcagcctattcatgttcacgctcgagatcagctgctgcctctgcgccagcggaatcgagcacgtcctgctcctccttcatctgctgcttgaccacctgggcgtattcgggaacgtattcctgcccgctcatcgcctggatcctgcgcgtgatttcgtcggtgagctcacgcagccgttcatgcgtcacctcgtcagatggagtcttctccacttcgatgggttcaccatagatcaccttggagtgccccttgcccggaatcacctgccccggcttctgcagttcgcgtgaaccgatgatggcggcaggaatgatcgggcaaccggtttccaaggcgagacgcgcggcaccggtgtgccccttgtatagacggccgtccgggctgcgggtgccttcgatgtggatgccgaacaggtggccttcctcgatgatctcacgtgcatgctcaagcgcaccgagcgactttgagccgcccgaacgatccacggggaacacgcccaccgaggtgaaccaccacttcttgaacttgcctttgatgcccttgccttcgaaatactccgccttgcccatgaaatgaatcatgcgcggacaggtgagcggtagcaacgcatcgtcgatcacagccagatgattggctgcaatgatgcccccgccggtgcgtggaatgttctggagcccttctgccacgggcttgaaacgatgccgcgccaccggaccgagcgttctcatgaagaaccaatacaacatgctgcctcctcctacatgtctcatagcatccgcttgctacagtgaacctatgactgacctcaacaatagcaacgacggcgaagaaacgaagccacacgattccgggcgcaacgggggtgattcgagcgagatctccgaggaggccgcctggaatcgcttcctcgacgagtattccgacgatctgggcgaggtggagcgatcacgcaccgcgaggaaattcgacaggcacgccacgcgtcaggacaaacgcgaggagaagagggcgattctttcggtgaacgacctcaaacagggcagtttcgtcgattcgtcaggcccgcgtgatttcacgcaatcgagttggctcgacaccgacgatgtgatggatcgcagcagcgtgttcactccccccaatcccgatctgggtcagattcgctggtcgcgtctcatctgcggcattctgctcgtcgtcggcgtcgccggcatcatcgccacggcgtttctgccagcctgggcgaccgtgctcggcatcgtcttcggcatctcgatactcgtcggcgccggtggcctgttcgtcacacaccgcggtcatgacgaaacgaagcgagacgaggaagacgacggcgctcgcgtataggattcccgaaagaacaaggtgccattcggccgtgcatagccgaatggcacctctggttatagggaccaggtaatccccgtactcctacaactcagtcgacatgtttgcttgcgacggcgatccactcgtcgagcagggcggcggcacgaccggaatcgactgcctgttcggcgatggcatgggcttggcggaaccgttcgcccagaggagcggaggcatcgataagcgagccatccgccacgattgcggaggcggcattgagcaatgccgtcgtacggaacggcacatcctttccggcgaagagatcgcgggcggcctgggcattgtagtccggctcgccaccacgcagatcctcaatcgtgaccttggcgagcccaagctcctcgatcgggtcgaattccgtttcgcagaccttgccgtccttgaattcccagacggagatcggaccggtcggcgccatctcgtcgagtccctcgttcgaggtgtacaccatgccgctctggccgttcgccgcgtagaccgcggccatgatcgggctcatcgcacggttggcgcaaccgattgccatatgcttcggggtcgccggattcgtcagcgggccaagcacgttgaacacgcacgggacgccgagcgcggcgcgcaccggtcccacgaatcgcatcgccgggtggaaggttttggcgaaggcgaaggtgatgcccacctcatcggccacctcggccacggcctgcggtttgagatcgagcggcagcccgagcgcctccagacagtcggccgccccgcacttggagctcgcggcgcggttgccgtgcttgacgatcgtcacgcccgcagcggctgcgatcaccgcccccatcgtcgataggttgacggtatgcgcgccatcgccacccgtgccgacgatgtcggtgcattcacggttcacttccaacggcacggcatgcgacaccatcgcctttgcggcaccagcgatctcatcggccgtcaatccgagctgctgttgtgtcgcgagcacggcaccgacggctgccgggttggcgttgcccttcatgaggtcatcgacgaaccactcggattcctcggcagtcaggtgattgccctgcacgagcttggtgagaatcgatttccatgtgatgtcggccatgaccactcctcgtttcgtagctgctacgcacagtctagggaacacaagcaacgaacacatgtcgagtcccgcatcatggtcaacacaaaaggggcgccgcatgcggcgcccctcgatatcgggttgaatatgctcactgctcgttctggccgtggcacatcttgtacttacgtccggagccgcacgggcatggtgcgttcttcggcgtgcccgggaatgtgcgaccgtcggaccatggggtcttgagctcctcgctcttcggacgcttgcgcgccggcaccttgccctcggcatggctcatcggctccgggccgagcagaccggattccggaatccgctcgccttcctccgccgcttccttgaccgcagcgatgttctcggcggtctccagctcgtcggcatgattgtcgatgcgcgcggcctcttcgggctcgtgctccgacagattgcccttgttcagctcgtcgtcctcgctcacatcgtcgcccatcttgatttcggcggaatcgaccgccgcgtcgtcgatggagtcagtgccgtcgtcgttcgtctgggcgatgctgtcgaggtcgatgtggaagagcaactgcaccgtctcctccttgatggcctcgatcatctggttgtacatctggtagccttcacgctggtattcgaccagcggatcacgctggcccatgccacgcaggccaatgccgtccttgaggtagtccatctcgtacagatgttcgcgccacttgcggtcgagcacggcgagcacgacgcgacgctccagcgtacgcaggccatcggcgccgagcttggtctcgaaggcctcatactgcgcctcggcgtcgtcgacgaacagcttgaccacggcgtccacggccttgtcgcccttgagcccttccgccgcctccttggcctcgtcaatggtcaccttggtcgggtacaggtcgttcacagccttgaacaggccgttccaatcccaatcggctggcttgtcggatccattcttcgcgcctcgcacatagctggtgagcgtgtcggagatgaaggcctcaatgtcctcgtgaatgtcctcgcccttcaacacggcctgacgttccgagtagatcacggtgcgctgcttgttcatcacatcgtcgtacttgagcacgttcttacgaatctcgaagttacgcgattccacggccttctgcgcattgcgcacgcccttggacacgctcttcgactcgatcggctcaccctcgggcatgcccttcgccatcacacgggcgacgagctgcgtgttgaacaggcgcatgaggtcgtcttcgaggctcaggtagaaccgggactcacccggatcgccctgacgtccggagcggccgcgcagctggttgtcgattcggcgtgattcgtggcgttcggtaccgagcacatacaggccaccgagcttcttgacctcttcgtgctcgtccttgacctgctccttgatcttcttcagggtctcaggccacagcttttcatattcctccggggtgtcgtccggcgagtagcccttcgccttgagttcggcgtcggcgaggaactcgacgttgccgccgagcatgatgtcggtgcctcgaccggccatgttcgtggcgacggtgacggcgcccttgcgacccgccacagccacgaccgccgcctccttctcatgctgcttcgcgttgagtaccttgtgcgggatctcaaccacgtcaagcagcgaggagacgacttcggaggactccaccgaggcggtgccgagcagcaccggctggcctttgcgatgacgcgcagccacatccttgacgatcgcggcgagcttctccttcttcgtacggaagatgaggtcgtcctgatcgatgcggatcatcggcttgttcggcggaatcggcagcacgccgagtttgtaggtgcccatgaactccgcggcctcggtctcggccgtaccggtcatacccgcaagcttgtcgtacatgcggaagtagttctgcagcgtgatcgtggcaaaggtctggttctcggccttgacctccacgttctccttcgcctcgatggcctggtgcagaccctcgttgtaacggcggccgggcagaatacgtccggtgtgctcgtcgacgatgagcacctcgccgccggtgaccacgtagtcgcggtcgcgcaggaacagctccttggccttgatcgcattgttgaggtagccgatcagcgcggtgttgctcggctcatacaggttgtcgatgcccaggtagtcctcgatcttcgtgatgcctgggtcgagaatgcccacggtcttcttcttctcgtcgacctcgtagtcctcgtcacggttgagcttgagcaccagcttggcgaactgacggtaccaacgggtcacatcaccctcggcaggtccggaaatgatgagcggcgtacgggcttcgtcgatgaggatcgagtcgacctcgtcgacgatggcgtaatggtggccacgctgcacgagctcgttcttctcccacgccatgttgtcgcgcaggtaatcgaaaccgaattcgttgttcgtgccgtaggtgatgtcggcattgtactgcttgcgacgttcggccggcttctggccggtgacgatgcacccgacgctcatgccgaggaaacggtagatgcggcccatcagctcgctctggtagctggcgagatagtcgttgacggtgatgacgtgcacgcccttgccttcgagcgcgttgaggtagctcggcaacgtcgccacgagggtcttgccttcaccggtcttcatctcggcgatgttgccccagtgcagtgccgcgccacccataagctgcacgtcgaagtgacgctgacccagcgtgcgcttggacacctctcgcaccgtcgcgaaagcctccggcatcaggtcgtcgagcgtctcgccgttggccaggcgttccttgaacttggcggtctgccctttgagctcgtcatcgctcatgaccaccatctgatcttcgagcttgttcacggcttcggcgacgtgttcgagcttcttgatctggcgaccttcacccatacgcagggctttgtctacgatatcaaccacatttactccctaacggtgtttgcaacaacactcctacaataagcggctcgagccccctattccacttttttcggctattctacgaagatttgcgcatttttggcattccttcgcattccgcacacaaatgtgtgaatgccgccccttttccgacaaagcaaaagcggcccgcaacgcgagccgctttccattgaggacgaaacctgttcaggccttgcgctcctcttcgagcttcttgatgttctcgggggtgtcgatctcgaagacgccgtagctccagccgtgacggtggtagacgaccgacggacggccggtgtccttgttcacgaacaggaagaagtcgtggccgatgagctccatctcatacagcgcctcatcgatgctcatgggttctgcgacatgcagcttgcgacggatgacaatcggggtgtcgccgacgtgaacctcgacggactcgcccggaccgagatctccggcgactgcggaggcggggctgttgtcgacgtcctcgtcacccatgatgtcttcgcgctcctcgctcggcggcacgaacttgcccgcatcgaccggcaccggcgtgtagttcttgcggtgatccttgcggcgatcgcgcgcacggcgcagacgcagcgtgagcttgtcgagcgccagatcgagggcactcacctcatcgaggctggacgcctcggcgcgaaccacggtcgaaccagccacaacggtcagttccacgcggacggcggtgtcatgcagacgtggattgccttcatgcgacagcacgacctgtacgcgctgcgcgtccggcgcaattgtggtcacacgattcatcttgctttcgacgacgtcacggaacttctgcttgatctgaatgtgacggcctgtcagaacgatatccatgtggacctccctagactcaagcggctttcacaccgctatatacggaccgaacggctactgccattcggatatgactcatattgtaatcgagttcgggcaagaattggcaagacacgcccccgctctcccctatttgttgaaaaaacggcgtcttttcccacgagtcggaacggattgctcgcgtcgcagatgcatatgccgcaccaaagcaccagtttcgtcacaaggcgcctcctccagccaccactgcaggcagtcacaccccttgctacaatcggacgcgagacctcttgatggccgcggccactttgtggctgaggaacttccgggctccacagagcacgatggcggataacgtccgcccagggtgacctgagagatagcgcagcagagaacagaccgcctgccttcgggccggtaagggtgaaacggcggtgcaagagaccaccgggcaactggtaacaggagccgcatggcaagcctcatcgggagcaaggccaagcagaaggctatagagttgctcgctctgccttcgggtaggctgctagagcctgacggcgacgtcaggtcgagatggatggccatccatgccttcacggcatgacagaacccggggtataagaggtctcactccttatctttcggtcttttcggcatgattgatttgaccgtcattcgtagatccgacgtcgaaacaactcgtcgcttacggcgcgcagatcctccggcgcatggcccttacggcctccggcggaccagaagcgccgtttgcagacctcgacatctttaccggcgttctttttcgccacagtcctgccgagttcccacgcgcagtcttcgaataccccggcctgtgcggtctcccgtaccatgcgttcggccagagggcgaggaacccccttgcgcaccagctcccgtatgacaccacgcgcacccatcatgcgggcggtgcaggaacgaatcacattgcgggcgtattcctcatcgtcaatgagtccaagctcctcgagacgcgcgacgacgcggtcgatcacctcggcatcgtattcccgttcgacgagcttgtcccgcagggatccgctggaccgcgcggccgcgtcgagcagacgcaatgcgctttccttgcactcatcttcgtcgtgcgaatccgccgccaccgaataggcgaagccaccagacagctttcgacgccgttccttcgtcgggtgcttccccggaacgtctcgatttgagctgttgggcgccgacggctcacgcaccatctgctcatgggagctcagaaactcctctgcactgatcattgcaactccattctccgcattccttcggtacggcatgcaatacgccggtgccccctggatcgagcgtcggccggccgacacccgatccacggggcacccaaagaagcactcaggcttcagcactcgtctgagcctccgcattcgactcactggtggttatagactcaccgttctcctcctcggtgccgtcgacgccgaactggtcgtcggtggagatgagcccggtcttgaccttcacctgagtggagatctcctcggcgagcttcggattgtcgatgaggaacttacgcacgttctcacggccctgccccagctgttcaccgttgtaggtgaaccaagaaccggacttcctcaccacgtcggtctccaacgccatgtcgagaatcgacccttcctgcgagatgccctgcccatagagcatgtcgaactcggcggtcttgaatggaggtgccatcttgttcttgaccaccttgacacgagtgcggttgccaatcggctcgtccttgtctttcagcgtctggatgcggcggatgtccatgcggacggatgcatagaacttcaacgccttgccgccggtggtcgtctccgggcttccgaagaatacgccgatcttctctcgcaactggttgatgaagatggccgtcgtgttcgcctgtgccagcgcaccggtcatcttgcgcagcgcctggctcatgagccttgcctgcagaccgacgtggctgtcacccatatcgccttcgatctcggccttcggcaccaacgccgccaccgaatcgatgacgatgacgtcaagagccccggaacgaatgagcatgtcggcgatttccagcgcctgctccccgttgtccggctgcgaaacgatgagcgaatcggtatcgacgcccaggtggcgcgcatacacgggatcaagggcgtgctcggcgtcgatgaacgcggccacgccaccgttcttctgcgcgttggcgaccacatgcaacgccagcgtggtcttgcccgacgactccgggccatagatctccacaatgcgtccacggggcagaccgccgatgcccaaagcagtgtcgagggccaacgaaccggtgggaatcacctcgatgtcctgttccggcctatctcccaaacgcatggcagagcccttgccgaactgcttctccacttgggccaacgccgaattgagcgcatcctcgcgcttcttgtcgacgccaggcgcctcggtcttctccgtctccttgacggaggacttgcttcgtgcagccatctgtactcctcacttcaacagtcaaacgcgccatgatcggcgaacaccccaaccctaccggcacagtgtcgggcggcacaagcgcgccggggccttgtggtcggaggacaccgatatccacacatcatatgcagcatacgcatgcaatcgacgccgtggcttttgcgatatgctcagtataccctctcatgcgaacatttgttcgaatacgcccatctgccgactggttctccacattctcaacacgccccgccagaccacccaagcacccctagtgaaaatcgacgggcagcggcggtgcattgtgatcccggccccaacgcttcgcatcgggcacatccatctggccgcacaacacattccacaccacacgaggctcttcgccggcggccagcgcctccaccaccgtcatgccatgcaacttggtgagcccctggtcatgggccaacgccctgccataggagcgaccgaacacttcttcgagcaactgccagaattcccgttcacgcatggccccaagcataaccgcgtcggcacagcgccgcaagaggagccgaccaacccagcttcgatatatcagatgcggcgcatagacacgaaaaaggcccgccaccaaagcagcgggccgacattcataggcgaacgcccgaattcacgcctcgacggaatcgaggtaatccgcgaccatgcgcagcatctgcgatgtgctcagacccagcgattccgagatggacgccagcagctcggagctggcctccttctggccacgctcgacttcggagaggtagccgagggacacgcccgccttctcgctcacctcacgcaacgtcttgtgatcgcgtgtacgaaggtcgcgcagtacatgcccgatcgccttgcgcagggacacttccttcacctcgcccacggtctcacgacggtgcaccatcgcgcgcggacgcgcggtctcggcgtcttcctcctgccacatgcgtgcgagggcggcctgatgctcgtccttggccttctttgcggcacgggcacgaagaacctgctgctgggcgaacatcaccgcacgacgctgggccggagtgagttcgcgcatgcgtgcactgcctgagcgcacctgctccggagtctcaaccgacttgacttcaacttgctcgttaaccattgtcatctgttccatcacgaacacctttcctttcctactacccctcatgagtttcccttgtctccattatcggaattttttcctgtgaagaacctgtgaattctctcatttttcccagaacacaggccacggtgagatgtctaaccagttctcgcgagccgcgtaacgctaatctgagcgcaaaatcacgttcctgtattacgctatgagaaaaacacggcacatcgaagccgatatacacggttcctgccggttttccctcgtcgggtccgggccctgcgacaccagtggtagacaaccccacgactccatgcgcatattgctcttggtaaaacagatgggcggccccgcgggccatctgccgcgcgacttccgggtcgaccgcgccatgggtccgtaagagttccgcatcgacgcccaacaccatcgccttggcgtgaatgtcatacgtcaccgcagaaccgaggaacacgctcgacgcccccggaatccgcacaaaggaatccgcgagcagaccagcggtgagggactctgcgcatgcaatcttgagtccccggacgtcgcagtgagcaagaatatggcgcgcctgttcgtcgcaataccgctgtacatcggccacgtcggtcacaccggcgagttcggcgacctcgaaaagttctgccacacctgctccctccacgtcgtcatctgcatgccgttcactctcagtgtgaaaaattgtgcagacattgtgaataacggcgtgttgtctgcatgttttgcatatgcaacggcaaagcaacgggcccgcacaccgaagtacgcgggcccgtatgcgatcgttgcgaccgttggtcagatattcgcctatttgcgcgtcaccgcaggtttcgcgaacacgcctcgcagatactcgtaaccggaatacaggcacagaatgagcgagaagtagatgagcgcatacgcgacaatgaagtacacggtcaaccacgccggctgcgacacggcatgcgtgaagctccacaccgggatcagcagcaatccgagacccaggcagagcgtgaatgtcttgtatttgcccgcctgcgacgccgcgatcaccttgccgccgtggtcgatgacgaagaaccgcatgatcgtgatgccgatctcacgcaccacgtagagtccggtgacgatccagccaatccacatgttgccaaattcgttgaaacaggcggccacgacgagcgcaccaagcgtgagcagcttgtcggcgatcggatcaaggagcttgcccagttccgtcacctgattgtatttgcgtgccatccaaccatcgatcttatcggtcgacgcggcgatgatgaacacgatggcggcgccccaccgcatgccgatgttgcgggcaccccatgcaccaccgccgatgtagagtcccaggaacacgacaacgagtacgattcgggcgagcgtcaccaggttcggcggtgaactccactggctccacatcgattgcttggttgatttctcagtctccatagtggctagcgtactcgcttacatgtccatagcgttgccgtgtcggacaacctgcaccatatcccgagaaacattcacaccggcatgccgccgggcacgcccagcaccaagtacatcagtactcggcagtgccggaggcgccagaggtcggttcagccggggctctggcaccggtcaggctgccgctctcccccttgatgaacgcaagcacctgcggcagatcctgaggctgcaccagcacctcacgggccttcgaaccttcggacggccccaccaccccacgcgattcaagcagatccatgagtcgaccggcctttgcgaagccgacgcgcagtttgcgctgcagcatggaggtggaaccgaactgcgaactgaccacgagttcggcggcctgcagcagttcgtccatatcaccgccaatgtcctcggtgggatcgaccttcttctggtccgcttccttggccatctgctcgatgtcctcgcggtagtgcggcttacgttgcgtgcgcacgaactcgacggccttgcggatctcagactcgttcacccaggcgccctgcacacgaatcggcttggccgagcccatgggcagaaaaagcgcgtcgccctgaccgatgagcgtctcggcgccggtggtgtcgagaatgaccctcgaatcggtggccgaggaagtcgcaaaagccagacgtgacggaatgttcgccttgatcaggccggtgatcacatcgacggaagggcgttgggtggcgagcaccagatgcacgcccgccgcacgcgccagctgtgtgatgcgttggatcgagctctccacgtcgttcttggccaccatcatgaggtcggccatctcgtcgacgaccacgagcagcgacggataaggggccaccttgcggttcgaccccgccggcgcatggaccttgccggcacgcaccgccttgttgaaatccttcacgtcacggaagccgaagaactccagatcgctgtatcgggcgtccatctccttgaccacccattccaatgcctgggccgccttcttcggatcagtgatgatcggtgtgatcaagtggggaatacccgcatatgcggagagttccacgcgcttcggatcgaccatgatcatacgcacctgatcgggcgtggcgcgcatgatgatcgacgtgagcatcgagttgatgaagctcgacttgccggaacccgtcgcacctgccaccagcaaatgcggcatcttcgtgaggtcggcagtcacgaaatgcccctcgacgtccttgcccacaccggtgagcataggattggggtcgttcatcgccttgtcggagcgcaacacatcacccagatgcacgatctcacggtcggcgttcggaatctcgatgccgatcgcgctcttgcctggaattggcgagaggatgcgcacatccgaactggccacagcgtaggcgatgttcttgtcgaggttcgtcaccttctccaccttgactcccggtgccacctccacctcatactgcgtgaccgaggggcctcgcaggaatcccaccaccttcgcatccaccttgaactggcggaacgtctcattcagcgcatggatcaccgtgtcgttcgcctgagtgtgcgcggcatgcggtttgcccttgacgagcaggttcagatccggcagatggtatggcgcatcaggctgttgcggaatgtcaggcatgccttcatggtcttcaggcgtcgcgggggatggcatggccggcggtatcctggagccggttggcggcatgggcgacgaggccggcgaccggtcgaggatctcgccggtctgggtggagaccaccatcgtctcgccctccgcatcgagatgcgcccagggatcggtgccggtggccgtcgctgcgggcatggagccggatggcagcggaatggtgcctgaaggctgggcgttccatgtgcccgagtcgatgcttcgcgtggcgtcgtcattgaaggcaccgccactgctcaccctgcgcgggccctcgtgcagatccgtttcgttggcatccccatggcggctcgcggcgttgaggaacgcctcgtcacctgcatagcgatcgagtttcgtgtcggtgccggggcccttcccgcgtcgatggaacagcctggcgaggaagccgaccttgctgtccggttccggcacgtcagtgccgtcatgcgcaggcacgccatccgcgaacgccaatgtatcgtcgcccacgcgcacctcgttcaggaactgcccgacctcgggatccgactgctgcgcatccgcggaatcagcagatccccgccgggagaatctactcagcttctgcggaatctcggtcacatgggtgcgcgtcatcaacagcacggagaacaccgcagccacgacgaacacgatgattgcgaacgtctgggagagcccccatgccagaggtgatccgacgacgaaaccgaccagaccgccggcctgctgaatgttctgccaggagaactccttcgtgtccgcagccatgatcacgtcgatgatcgagcagatcgaccacagcaacatcactccaccggcaatcacctgcgtgttgtgggattgcttgccggagttgcgcatgaggcgaatcgccaacacgatgagcagcaccggcaccaccacgctcatcacaccgaagatcgcggaggcgaacgagtgcagcccgcgtccgagcgctccgtcgacgcggaaccattcggacccgcagaagaacacggcgaggatgatcatgacgaagcacaatccatcccgacgatacgccgggtcgtactcccccacgctcaccttacgcacggcagagccgaacgcccgtggcacacatagcaatgccttgtgccagaacggttccgctccttggttccgcgcaccaccctgtgaactctgcgcggaacctgcacgtgaccccgtcccgccgccggaggaggaacgggcggtcctgcccttcgatgatttggaagatgattgtgccataacggttgaattctacctcagaccggtcccgcaccagacggccggcgaatatcgcccagatgatgctgcacatattcctgtgcatgcatgtcgatggcatcgtagtcgccggcgtcggcgtggtcgatgaccgccatcgcattgtcgaccagagccgggttcaatgccgagagccagtggatgcgtgggtctcggccgaaccatcccatttgcttgcgggcgaggcgcttggtcttctgcgcgatgtctgccatggtgtcgtccaaatcgaccagaccatcgagatggtcgatcacctgctggtagccgagcgcacgggctgcggttggccccagatgggaacgcagacgcgccacctcatccacgaagcccccgtcgaacatctgcctcgtgcgcacgtcaatgcgcttgtccagatcggcacggtcaaggtcgagccccaattgcaccgacggaatcacataacggtaccggggcaacgtggccgaatacggtttgccggtcacctcgatcacttcgagtgcgcgaatgatgcgacggggattgcgcggatccatatgctcggccgcctgcggatccttgaccgccaactcgcggaacaatgccgtggctccctcggttcgctcacgctcctccagatgctcccgaatctgcgggtcggtgcccgggaaggagatgtcgtcgatggccgcacgggcgtacaggccggagccaccgaccagaatcggccgtatgccacgcgacttgagatcggcgatggtttcacgcgccatctgttggaacctcgcgacagacatcgtctcgctcggctcaatcacgtcgagcagatgatgcctgaccgccgcacgttcctcgtcgctcgccttcgcggtgccgatatccatgccgcggtacatctggtaggcgtcggcattcactatctcggcacgttcaccacgatcggcgagtctccgggcgatcgcgatgcccaggccagttttcccagaggcggtggggccgacgatcgagatcacacgcgcgccgtcatggcgctcaactcctgcggatggcataggtctgtcctttggcgagatcggggtctgcaatcaggttatgacggccagcatgggtgacggtggcagtgacgaaatcaccgatctgcggtgcatcatgcccttcgggcacccccacatgcaccagcacgccggttttctcgcgaccggtgtagcggtgcgtctcggcatccttcttcccggtcacaccggtgatcatcacctcgacgtcacggcccacgaacttctcgagaatctcctcggtaatgcgctcctgcacggcgagcagacgttcgagcctgtcgagggccacgtcatagggcacctgttccattgcggctgcgggcgtgccgggccgcggcgaatagatgaacgtgaaggccgacgagaatctggcttcctcaaccacgcgcagggtctgctggaaatcctcctccgtctcgcccgggaagccgacgatgatgtcggtggagatctgtgcatccggcatcgcctcacgaatcttcgcgagaatgcccaggaacctctcggaacggtatgagcggcgcatggcgcgcaagatgcggtcggatccggattgcagcgggaaatgcagctgatgcatcacattgggggtctcggccatcgcggcgatcacgtcgtcggtgaatgccgccgggtggggcgaggtgaaccgcacgcgctccagtccctcgatctcgccacaggcgcgcagcagcttggagaacgcatagcggtcgcctatgccatagccatacgagttcacattctgccccagcagcgtgatctccttcgccccgttcgtcaccgtctcgcggatctcggcgagtacgtcgcccggtctgcggtcgcgctccttgccacgggtggtgggcacgatgcagaaggtgcacgtgttgttgcaccccatcgagatggccacccatgcggaatgggcggaggcgcggtgtgcgggcagctggctcgggaagagcgtgagatcctcgttcaccttcacctgtgtgtgttgcgctgcacgggcctgatcgagcaatgcgggaaggtcctctatgttcttcgtgccgaacacggcatccacccatggcgtacgtttggcgatgcgttcgcggtcgagttgcgccatgcagccgccgatggcgatctgggcatgcgggttcctgtatttgaaacgcttccatttgccgatggtgccatacatgcgttctgtggcattctctcgcaccgcgcacgtgttcatgatcacgacgtcgacatcgtgcgccaggaactgctcctcgctcgccgggcggtagccgttctcctccatcacgcccgcgatgcgctcggaatcgtgcacgttcatctggcagccaagcgtgtgcacataatacagaccgcgaccacggccggatgctcccccgtactgcggggcgccgggctcgacctgcgtcgtatgctgtgcttgcgatatgttcgtgcggcgttcctcaggcgtcatcatgtcttcgttcatagaggccatgctaaccgaagctcggcacagtgggtcgcccggacgtggattccgcacgcgttgttcgctctcgttttctacaatggcaatgtgatactcgacagacagaaacggatgaacaccgcggagatccgcgcccgcctgacggcggccgggcattcgctcggattggacggcaccgaggagggggaacggggcgtcgacctgattaccgatttcatcaaccagatgcagatctacgaaggtgcgatgtacgagatcagcacgaaactcgagattctcgactccgaatttcaggtgcagttctctcataatccaatccaccacctcgaacgcagattgaaatcaaccgaatctattctgggcaaactcgaccgacgtggccttccctatacggtggaggcgattcgtgacaacctgttcgacgtcgctggcatacgcgtgatctgcaattaccgggacgacgtgtattcggtggcgaattacctctcggcgcaatcggacattcaggtgctgcgcgtgaaggattacatacgcaaccccaagcagaacggctaccgctcgctgcatgtgatctatgcggtgccggtgttcctgtcgagcggcgcgcattacacgccggtcgaagtgcagttccgcacgatcgcgatggactactgggcgagtctggagcatgcgctgcgctacaagaccgatctgcccgacgacaagcacgccgagcattcacagacgctgctggactgcgcgcgtgcattgcagaacgtggagacgcagatgcagacgattcatcgcgacatcaacggcgcaccgcagggtggcgaggcaccgaccgcgaatgaggactccccgattcgcaatgcgacgctcaaggggcagtgagcttccgcagcggaaaacagatggggcgaccgtgtttccacggtcgccccatctgttgggagtgcccggacggaacctgtcggttctaatcgcggctcaatccaagcgcctgcagaatgtacaggaacaggttgatgaagtcgaggtacaggttcagcgcgcacaggatggagatcttcttgattgcctccggtccctgcgaggcatagacggcgaacgccttcttcgtgaactgcgcgtcatagatcgtcagtcctgcgaacagcaggatgccgattgcggtgaccaccttgagcatcgtgttgctcggcgccacgaacatcatgatcacctcggcgatgatgagcacgaccagtgcgatcatgaggatcggacccgccttgagcatgttgcccttcgtggtcagaccgaacatggtgagtgcgaagtagaagccggcgctcaccaggaatgcgatgccgatggtgcccagatcgtaggccaggaagatggtgctcagcgtgacgcccatcagcgccgcatacacgtagaagcacacgcgggcggccgtggtggacatcttcatcacgcgcatgcccagatatatggccagaccgatctcgacgatggcgaggatccacatgcccatgccgcccgtagcctgcaggaagcgcatgtagaagccgctcatctgcgtgaagatcgccatggcggcggtgacgagcaggcccaggcacatctcgccgtatgcgcgcgtcaccgagacatgctcggcgcgctcgtatgactgcgaggcctgaacattgatcgtgttggcatagttcatcggttgctgcccatatggttgctggccatatggcgagccgttcataggctgctgcccataagtcatgttcgttccttctgtcgtatgtgctaacagtataggctgttcgtgcagggaatacccccagaggaggctgaaagccggctgggagcatatgcatcttcactcattgtaggcaacagccatggaacgcaggtattccgcagacggcctgccgattatggaggttccgcgaagccggacgccggcggggtttcgtccgctatagtgggaggcacggcccgcacacgcaacgaggcgtgatggccgtcaagcaaaggagtggttatggaacctattcgcgcaatccaattcggctgcggcaagatggccaagtacaccgtcaggtacatgcatgacaaaggcatgcagattgtgggtgccatcgatgtgaaccccgacgtggtgggcatggatgtcggcgagttcgccggaatcggaccgctcaacgtgacgatcagcgatgacgccgacgccgtgctcgactcatgcgatgcggacattgcggtcgtcacgctgttcagcttcatggacgacatcgaaccgatgtgcgaggcatgtctctcccgcggcatcagcgtgatcaccacctgcgaggaggcgatctacccgtggacgacgaatccggccgtgaccaaccgcctcgaccgcatcgccaaggagaacggcgccaccatggtcggctcggggatgcaggacatcttctggatcaacatggtggcccaggtggcaggcgggtgcaattcgatgacgaagatcagcggcgccaccagctacaatgtcgaggattacggcctggcgcttgccaaagcgcacggcgtgggtcttacggccgagcagttcgaggagcagctggcgcatcccgacgaggtggtgccgtcatacgtgtggaactccaatgaatcgctggtgcagaggctcggactgacgatcaagtcgcagacgcagcgtgcggtgccttacttcagcgatgtcgatgtgtattcggagacgatgggcgagacgattccggcgggggtgtgcatcggcatgtcggcggtcgtcacgaccgagacgatgcagggactcaccatcgagacctcatgcatcggcaaggtgtatgggccggacgacggcgatatgtgcgattggagaatcgaaggcgaacccgacaccgaattccatgtggtcaaaccagcgactgtggagcacacctgcgccacgatggtcaaccgcatccccaatgtgctcaatgcgccggcaggctatgtgacggtcgaccaactgcctgagatcaaccatctctcctaccctgcggcgatgtacgtcgcctgacacgctccggttcaggcgagggcatatctgaggggcagcggcgctgaggagcgtgctacgcgcgtagcgcgcagacaccttgacgaagcgcctctgcccctcagatatgccctcgcctgtttcgctagacctcggccaattgggtcgaggccggagccgcaagattcgggcgcagacggcgcatctgcgacaaggcgagtcccaatgcgatgaacgccacgccgaacagaagcaccaacgcaatacccgggaaccagttggatacgctcacggtgccttcggaattcatcgcggcgctgatcgaccggcagaaccaccaacccggggtgcatttgcctatgacgatcatcaccttgggcatcagatccaccgggaacgccatgcccgaggtgaacatgatgaccagaccatacacattggcgatcgcgttgattgccgcactgttgacggcgatcatgctcaccatgaagccactggccgcggccgtgagactataggcgaccatcgtcaatgcgcacagtaggaatcccctcgggtcgacgccggtgatcggcaagccggccgccaccggaagagccagggcgagcgccagatagaacaggctcacgagcacaccgaacaagccacaacaggcgaactgctggaacagcatcgaaccggtgcgttgcggtgaggcatacatgcgtctgcgtacccttgcccccgagaacgatcccatcgtcattgcggtgatcgtgaacattgccgcgaccatcggataggctcccatgtccatcatcgtctggaacgcgtaccgtccgttcgcctcccggtcgtcggtccctgccgggtcctcggcgatggcgatctgcgggtaggcgtcggcattgccggtaagatccgcgatcaccgaaccggccgccgcattcaatgaggcgacgctaacggaggaacccgacgacgctgcatctgcaagcgcagtcatccgggtgaggttcaggaaatcctccacctgcagtttggcgagggagccgtaggctccggtgaagctggtgaccatctgcagctcggggacggcggaatccgaggtgaatgccgcagccaggtcatcgacatagtgttcgggaatgatgacgatgaggtcggcatagtttgaggccgcagcggtctgcaggtcctgggaggtggtgcccacatcgacgaggtcgcagtccttggacaggaatttcctcagcgaatccgagaaccctgagccgacgcccccattccggtcgaccaccgccacttcgggtcgcagcgtctcataggtggtggagttgtcggtgttcgaaaggttctggatgatgctccaggacagcccgaacatcatgaggctcaggtagacgatgtagacgaggatcatggttcgttgggcgaacaggactcgccagcatgttctaaaggtgctcatagcgttgcctcctgaggaagatcgtggacagtgtcagagcgagcacggtcattgcgaggagaatgcccgacgtgcgtagggacggggcgtaggaatcgtagtggagcaagtcgtagaacaggttcgtgatctgctgggtgggattgacgatggcgaatccgggggcgttgcgttgggtccagtcgctcaggttcattgcgccggtgccgtagagtccactgaatatcgagagcacgcacgacagcgcggtggtgatgcctattttcacgccggaagtgagcttcggcaacgatcctatgagcgtgccgagcgcattggcggtaagggacgcgagcagcagcgccaggacgagcacgggccaacggccgccgaaatcgaccttgcacacgaaatggacgtagagcgtcgcaaccaccatcgacaccgatgcgcatagccagctggcgaggaaacctcccatgagctggttgaacttggagagcggggccagcgaccgtctcataccaagcgccgaaagattcgcctgcgtggcgcacacggtcgtggtggcgaaggtcatcgacatgagtgcggtcatggcgagcagcgcatagtagaatcggacggattcggtcggcttgaaatgggtggggctcacaactttcgtgaacgtcggggtgtcgcccatctccttggtgaacgtggcatcacggaacacgcccgaatcggtgttgagcagctcggtcacggtgatggctcgcctattgaacatgcctacggcaccatgcagaatgttgagggatgcactgaagccggaatttccggtgtcatcgttgacggatgcgacgctggcacgactgatcgtcaggttcagcagcccgtcttccgtggcgttgatgtagccacgcaccccgtggtcggcgttgatgaggcccttggcctccttgacgtttgacacggcctgcaattccaacaggttcctgagctcggaacccacctgcccggacgccgtatcgggcgcagcgccttccatggcgttcccgcagccctcgttccgcagtggattccgctgcatcgcatgcagcatctgacgcgcgttggtcgccctgcagaagttcgcgtccgcgaccactgcgaacctcatcgtatgtatttcatagacctcgccgatgttgccgaacatgcccatgaacatcgtcgacagaatgatcgggaagcagaagagccagaacaccgaactcttctcacgcagattcacgcgcatggtgttgaggaatgtactccacatgtattcacctccttcgtcgtatgtgccgcacgctcaatcgcgcaggtcggtcccggtgagggcgaggaacacgtcgttcaacgtcggcgcacgggagctcacatgccccatggggatgtcgagcgagcgcagcacctgcagcacatcgatgagattgtgctcgccctgcgaacagaccaccacgagctcgtcgttctcgaacgtcacctcgtgcacagcctccaagtcacccaacatcgagacggcccgttggcacagggcctcattcgcgctcaacgccggcgcttcgacggtgattcgctcgccggcctcgatcatgcgcttgagctcgtcggccgtgccgatggcgatctgacggccgtgatctatgatctggatgcggtcgcagatctgctcgacctcctccatgtaatggctcgtgtacacgacggtcgcgccacgctcgttgagccgtttgatgccttcgagaatcgagttgcggctttgcggatccaccgccaccgtcggctcgtcgaagaagatgggttcgggttggtgcactatgccgcatgcaatgttcaatcggcgcggcagacctcctgagagcttgcgcgggcggaatctgcggtaatcctcgagtcccacgaattcgattgcttcgtccaccagccgcgcacgtctcatcttgtcagcgacgtacagcgagcagaagtactcgatgttctcctgcacggtgagctcgttgaatacagccacgtcctgaggcaccacgccgatcctgcgcttcaggtcgtaggcggtggggcccatcttgccgccgaatgcacggatttggcccgaatcataggtgagcaacccgagaatgcagttgatcgcggtggtcttgccggaaccgttcggccccagcaatccgtaaatctccccagtgcgcacgttcatgttcaaatagtcgagcgcgagcttgtcggcatatcgtttcaccagttcgcgcacctcgatcgctggtgcggcatcgcgctgtacgttgttctctgctgtgttcatgcctccatattgccgaacaggcaacggccgacacggtgccaggaatcaccgtttttgtacgaatggtgacatttgtcaccattcggcatgacattcgccctgttgtcatgaacaatggaacagaataggaggggagagacaacggcatgatcatctccgtgggagctcatgcgctgatgttcgtcgtcagcgtgctgttctcggtgatgctgagcggcgacaccgataccaccttcgtcattggtctgctgttctgcgtgatcctctgctcgttgatccgtctggctcccctcagatgctggatcgcactcgccatgatgttctgcatggtctgcctgtttgttccgcaatggatcgcgctgatgccgatcgtgggcttcgatctgggattgcgggtgcagtcgttgggcaggtctttccaaatgctggtctgcgtccccccactggtctgcggaatcgtggccggtcagcacagtccggcattgcacgatctgtcagccgcagccacctcgccgctcgtgatggccctttggattctatgtgcgctcacctccctcgcagttctcggcggctgggtattcgcactcgcgcaacgaagacaacggtgcttccaatcgttggcagacgaccaacgggaacgtatccgccgttcgcgcgctcgtctcgccgatgtcgaatccgccaggtcggcggacctgcagcatgcgcggctcaccgaacgcacacgcatcgcacgcgagatccacgacaatgtgggacatctgctcactcgtgcgatcatgctgacgaatgcggaccaagtgattgccaccagcaccggtgacacgctgcatgccgatcaattcgggcagcttggtcataccctcgacgaggcgatgacgatgattcgcaaatccgtgcatggtctcaaagacgaaggcactgattttcgggcgatggtcgaggatgccatggccaccgccaagcaatctgatgtcgagattcgcctctccaatgccatcgatgccgtgccttcccatgtggcacatgcattcacggccgtgattcgcggagcgttgacgaacacaatccggcatagcgcagcttctgaggcccacgtgcatctgattgatttgccggggttgtggcagctgatcgtgcagggcaacggcggcgtaccggaacgcggccgcgtggcgagcatgggcattggaatcgccgacatcgaggaacgggcgcgcgcattggatggcacagccacctgcggctaccataacggcggctggcgcgtgttcatgtccgtcccgaaaacagcggaaaggaatatgcgatgaaggtcgcgattgttgacgatgaccctattgtctgctcgtccatcggcacgatcctcacgaccaccggcaccgccgaggtcgtgtggactgcgcatgacggggccgccgccgtggtggcctatgcacgtcagaaaccggatgtgttgctcatcgacgtgcagatgccgggcaccgacggccttgaagccagcgagcgcattctcgtgctcaccactttcgccgacccggagtacattcgccgtgccatcgaattgggcacgaaaggctatctcatcaaacaggacgtggcttcggtgattccagcagtgcaggcggtcatggccgggcaggtggtgttgggcgcggacgtgctgcgcaacctgccgatgcacgatgcgtccgggaatgtggaggaaccaaaggcgtccccattaccggatgatcccagattcgcgcatctcaccgaccgggagcatgacatcgtcgagctggtcgccgaggagctcgacaatcgtgagattgcggcgaagctgttcctgagcgagggcaccgtgcgcaaccgcatcagcggcattctggcgaagacgcacatctcgaaccgcacgaagctcgccatcgaatggctgacgtcgcatgaccgtcacatccatgaccatcacatcgaggtgcgataggtcttccagatatcgctcaatgcacggccgtcggattcccgcttccatacgttcaggctcgccgaggaacctccgatggcgcgggcggcggacgtcggcgtcgcatattcggtgccgtcctcgccccggaacccagactcggtgacggtgatacgccagatctcgtgcttgcgtgggcggttccatacgaatcggtcccccaccgtgagcagaccggcgcgcaccacttcgcccaccgtcacacgcttcgacgtgcgtcgactgcgatgcgcggatgtgcctgtgcgatcggactgcccctgcggctctgccaaggatcccagctcccccggattgatgttccacgcctgtgcgatcagctcgacgatctggtgctgccgcaattgcaggaactgcggcgtcagcttctcaagttcgccgatcacgcgcgtcaacgggaactggcgtgagcttgggctgcgcagaatgcgggctcgtcgcgtctggaagtcgtcgagtccctccatcgatttgcgggtggattgggtgagcacatagttgcctatgcgctccgcccagtaatcgcactgaccggcaggccaatccgcaaaatccgaccccgactgtatacgtacgggaatgagcggcaccgcattgagactacgcggtcgggtgatacggccccctgccagctgctcgttcgcacgaatcagcagcaggcgtttcatattgctgtcgatcgacagttcgccgcgcagatgcagcatggcgagtcgttgctcgtcgccgtcgacgtggaagcctgcgatgcgctgcaatgggatgcctttgttggctcttctcaggttagtgtgtaaggatgtctttgagttggctgctgtggatgaggcatcgttggatgtagctggtggtgttggcgaagcccatggcgttgccgcgcagggtctcgagcctgccgttgatggcttcggtgggtccgttgcttgagcgggggtggcggaagagggcgaggatgtcgcgcatgcgtcttttgagcacgcggccgagggaggcgagttcccggcagcctttgtagcgccccggtccggtcaggtcgtcgatcagctcgcgcatcatgcgttcgccgcgtcgcctgtcgtcgcaccggtaggcgtgtatgaccctttggtaggcgtcgtgggcgagcatgaggtcgcggttggcctggatggcgaacagggccatgagtctggcacggccgcgtgcgccgaggtattcgtcgctggtcagcagggcgcgcctgcagtcgtagagcctgtcgcccttgacaccgcgcctgccggtggcgtcgcgttgcaggcggcagcgcaccctggtgacgcgggcggcggccagttgcacgacgtggaacgggtcgatgacctcgaccgcgtggggcacgacggattcgacggcctgcttccagccggcgaacgcgtccatggcgaccaccccgacgcgtcttgtgaactcgccgccgcgcgcctgcatccattcgcgaagcacctgggcggaacggcccggcaccatgtccagcagtcttgccggcctgccgtcgcaacgcggggtcaggtcgacgatcacggtcacgtaccggtcgccgaacgcgccgtggcgccacacgtgctcgtccacgccgatcgcgcgcaccgaggagaaccggtcggcctgctcgagcaacagcatgccccgctcgcgcaccgcccggtcgaccaccgcccatgccacatgaagcagcctggcgcacgccgagaccgtcatcgagtccaggcacacgcgccgcagcgcccacatcaccgccggcacgctcaacacgcccctgccggcgcccaccgcctcaggatcatcgctccacgagcgtgagcacggcacgcactcgtagcggcgcacgcgcaccagcagatgcaccgcgtcgtcgccgtagggcacatgcgccagcgtgcgcagccacgacgaacgcaccctggcatacgcgccgcacgaggggcaccagcgcgcgtcgtgcgagtccggctcgcacctgatctgccttaaccccgggccgtccggcctgccaagacgccgccacgagagcacacgaagacccatctcatccaaaccaaggaaacgttgggggtcgaacacgctaaactcgggttcaggccgtgtttcctcattcaatttctctatcacacaagcaatgatgaagcacggcccttacacactaacttgagaagagcccctttgttcagatcgcgcacgattgtggacgcgcgtgtgcgccgttcgagctcgctcttgccgttcaggcaatcggtgccggtgacgcggtcgagcgaggcgagcacgtcacgcagacgttgggcgtcatgcaccttcacctggtgttcgcgcccatgatccgccgtctgccgttcgaagacgacggtgtcagggtcgtcgagtcctttgagcgaatgcacgagcacccacatggcgactggatgccagtccttggaggggtagtcattgagtcctatgagcagatcgaccacatcgtccggcaacaggctttctccgggtcggtgaatgatctcattggcgatcgcgtatggccgcagcacctcgtcgatgtattcgatgccctcgcccttgcgcatatagcgctcgagcacatggtccatgaaatcggcgatgagtgattcacacagcggtgtcttggtggcgatgaggtcgagatccttgaagaagcgttcgatgcgttcggtgtcgtcgcccatcggctccatgatttcgtcccaatacctggcgtaggcgtcgcgtgccgccggtgagatggacgaaaccaccttcgccttgaacacgtcggagggggtcaacggcatgccacgcatgttcatcacgtcgaagatgcggtaggcgccggagatgtcgtctgtggtcacgatgacgaacatgacatcgttgaccaggtattgcgcgaactggcggcgttcgtcgtcctgcatacgcgccaggatgtcgtacgcgcatctcgtgttgccctgaatattgcgctgggcctgcgtgtggatatcggtctcgcgcaggtcgaacagcgcctcgaggtcgccctgctgcacgtattcgcggaagaacccctcatcctgctcacgcaaggtgagtctcggctccgcgttgatgccacgcagcttgtcgccggcctccataagcagtccttccagactggaggtcagctgcgggtcctcctccaacgcaagcaggatcgaaaacaggatcgacagtgagaccagacgttgctgcccgtcgatcacctggtgcatgccgcgttcgtcatgcacgagaatcagcgacccaaggaagtacggtccgtcgtgcaacgcgcaggcgtccatgacgtcgttgacgagctgccgcatctgcgcatcatgccaactgtatgatcgctggaacgagggtatggtgaaccggtagtcggaggtgaacaccttcgacagcggcttctcactggcactaatcgacatcacgtcccccttccggcatacgccgatcgtggcagggatgcgtggtgcgcccgcacgacgcctgccggtcgcccgcaatgatcgacactgttctttgcctcacgctgtcattgtaacaagggtgacgcgccggggttcgtgccggccttagattccctctttccatgcacgatattcacgtgccttgcgctgccactgttcgtggtcggcatcggtgatggcacggatcgggcggcacgggttgcccacggcaatgcaatgtgaggggatgtccttgaccacaacggagccggcgccgatcaccacgtcgtcgccgatcgtgacgcccgggcacacggtgacgttgccaccgaaccatacgtcgttgccgatggagattggcttgccgccctccagctgttcgttgcgcacctgcgcatcgatcgggtgatagggtgtgagcaggctgacccgcgggccgcagaacacgttgtcgccgatgtcgatgcgtgccacgtcgaggaagatgcagtcggtgttcgcatagaaattcctgccgatgtaggtgttgcacccgtaatcggcgcggaacggcggctcgatgtacgagccttcgccgaaactgccgaacagttcacggaacagggcttcacgcttgtcgaactcgtcgtagtccgaacggttgatctcctgcacgagcctgcgacgcttgaggctgtgttccttgaggtacgggtcgtctgcgatgtacagctcgccgctcagcatgcgttcgtactcgcgggtgtcggcactggttccgttggtcatggcgttcgtcgttccttgggttcgggattcattctctggctcaaggatatccgaggacgcacggattgcaatccacggcatcccagaacattccaatctgcgcagattggtgtattctgttctatgaaagcgtttgcaataccaaacgaacgctctttcaaaggagaaagatatgacattgctgtggagcagtctgttcacgatcatcgtcgtggggctggcactgtgggtcctgtattacatcatccgcgccgctgtgagcgccggcatcaaagacgcctatgcccagatggggttcattcgcgagcccgacaccaaggaagaccagctgcagcgtaggcgtgaggaactgcaggaagagcgcgtgcagaccatcgtgaattccgaggcggatcgaatgtcggggaagaacggcaagcactgaacaagcgttgaaataacgtcttatatgggaaggggcgcacctcgttggaggtgcgccccttcccatataagacggaccaatgctcacttcatgagattgcgcagcacgtactgcagaatgccgccattgcggtaatagtcggcctcacccggtgtgtcgatgcgcacaaccgcctcgaattcagtcttcgagccgtctttgtgtgtggcctcgacatgcacgctttttggcgtgacgccgttgttcagctcggtgatgccggtgatgctgtaggtctcggtgccgtcaagccccagcgattcggcggactcaccctcggggaactgcaatggcagcacgcccatgccaatgagattcgaacggtggatgcgctcgaagctttcgacgatgacggccttgaccccgagcatcgcagtgcccttggcggcccaatcgcgcgaggaaccggtgccgtattccttgccgccgagcacgacgagcggcacgccgttgtcgatgtagtcgcgggacgcctcgtagatggtcgtcggcttcatcgccaggaaatcgtaggtgtaaccgccgggcctgacctcctctcccaccgaggcgaggagcatgttgcgcagacggatattgccgaaggtgccgcgcaccatgacctcatggttgccacgacgcgatccgtatgagttgaagttcttcggctcgacgccatgttcgacgagatacttgcccgccgggctcgaggccttgaacgcacccgcaggagagatgtggtccgtcgtgaccgaatcgcccagcagcgcgagcacgcgtgcgtcgcgaatgtcctcgaccggagccggcgtggcgctcatgccgtcgaagaaggtctgcttgcgcacgtacgtggactccgggttccaggcgaacagctcgccctcgggaacatcgagccccttccaacgcgaatcgccctcgaacacgctggcatagtcgttgaggaacatctcacggctcacattgccgctgaccacctgctccacctcggcattcgtgggccagatgtctttcagatagacgtcgttgccctcaggatccttgccaagcgcctcatgctcgaagtcgaagtccatcgtgccggccaaagcgtaggcgatgacaagcggcggcgatgccaagtagttcatcttgacatccgggctgatgcgcccttcgaagttgcggttgcccgagagcacggcggtgacggtgaggtcgttcgcattgatcgcctcggagatctcgggcagcagcgggcccgaattgcctatgcaggtggcgcagccgaatcccaccagttcgtagccgagacgatcgaggtcgtcttgcagcccggcctgtttcaggtagtcggccaccacctgggaaccgggggccagcgaggtcttcacccatggcttgggcttgaggcctttggcgaccgcattacgggcgatgaggccggcggcgatcatgaccgagggattcgatgtgttcgtgcacgaggtgattgaggcgatggccacatcgccgttcgtcaattcgaaatcaccccggaaatcggtggagacgggaacagggttgccgttcgtcttctcggtgatgtatccgggaagcgtctgctcgaaggtggtcttcgcatggctgagttcaatgcggtcctgcgggcgcttcggtccggcgattgacgggaccacggtggacaggtcgagctccaggtactcggaatagctcggttccacgaaattcggatcgttgacgtcatgccacagcttgttcgccttggcataggcctcgacaagggccacctgctcctcggagcgaccggtgagacgcagatagtcgagggtcacctcgtcgattgggaagatgccgcaggtggagccgaattcggggctcatattgccgatcgtggcacggttcgccagcggcaccgaggcgatgccctcgccatagaactcgacgaacttgcctacgacgccatgacgacgcagcagatcggtgatcgtgagcaccacatcggttgcggtgacgccctcgggaatcgatccggtgagcttgaagccgaccacgcgcggcaccagcatcgagatcggctggccgagcatggccgcctcggcctcgatgccgccgacgccccagccgagcacgcccagaccgttgaccgtcgtcgtatgcgagtcggtgcccacacaggaatcgagataggccagcgtggtgcccttcgagagctccttgcgcatgaccacctgcgccagatattcgatgttgacctggtggatgatgccggttcccggcggcaccacgcggaagttctcgaaggcctgctgcccccagcgcaggaaccggtagcgttccccgttgcgctggtattcgatgtccatgttgatctcgacggcgttctctacgccgtaggcgtcgatctgcaccgaatggtcgatgatcatgtcggactgcacctgggggttgatcacctcgggatcgccgccaagcgacttgacggcatcgcgcatcgtggccaggtcgaccacgcagggcacaccggtgaagtcctgcatcaccacacgcgaggggatgaactggatctcatggctcggatcggccgcaggatcccatgcgagcaattcccgaacctgctcatcggtgatgttggcgccgtcgatgttgcgcaccaggttctcgaccagcaccttcagcgagtacggcaggtgatcgacgccttcaagatcggcgatgcggtagtagtcatacgacttgtcgcccaccttgaggacatccagctgttcgtcgcgcagagacatagttcctccgaaatctcatggatgttgcgtgccactaacactacagggcgtttgtgtcaaccctttttcagccgtttgtattgtgagatgcgccattaatcccggtctcgcggcccgcctcccgcatccacttgggcaggaagcgcgagaacacccagatgctgatgacgaacagcacggtggcgacggccatctgcagcaacaggatccacaccgcgcgccccgcgggcagcccgaatgcgaagaagcgcgcaatgaacgggatgcacgcgccgatcacgccggcggcggcgaaggcgagcaccagccagccacgccatgaattgagcggcttcgacaccctggacagcacgtagatgcccatgaggaacagcacggtggcacacatcgaacgcaaccagaacagctgctgctccgaggtgaacacattccagtgcatgaatctgggaatgaaccaggcgctcagcagcaccgaaagtcccgtggcgatgccgcagggcaccgagaacgcgaccaccctgcgtaggaagccgggaatgtagcggcgcgtgttcggggcgagagccaggaagaacgccggtgcgccaatcgtcagcgcaccgatgtaactgatgtggcggggcagatacgggaagggaatgcccatgagcaccacgccgagggaaatcagcgcggaataggcggtcttcgtcacgaacaggctcgccacacgctccatgttcgccatcacctgccgaccgcgcgccaccacgtcgggcagatgcgagaacttcgaatcgacgagcaccacctcggccacggccttcgtggccggtgccgcattgcccatggcgatgccgagatccgcctccttgatcgccagcgcgtcgttgacgccatcgccggtcatcgccaccacatggtcctgcgtgtgcaacgcctgcacaatcgccttcttctgttcgggcagcacacggccgagcacgtccactccctcgagcacccgggccagctcatcgacgttcttcggcagctcacgtgcgtccatcgccacaggcttgcgctcgccggtcaactgcaccttcgcggcgatggcgcccacggtcaccgggttgtcgcccgagatcacacggcaacgcacgccctgttcacggaaccagcgaagcgtcggctcggcatcggaacgaatgtgctccgagcacagcacgatcgcgacgggcaccgccgtacgctcgagttgcgggttcgtttcgaaatcggcaggcacatcgccgccgggaacatgggcgatgagcagcacgcggttgccattgttggcgtattcgttcacctgcgcgagaatctgctggtattcgccgtcgaaaccgctcagcagcacctcgggggcacccatgtaccacacgccattctggccttcgtcgggaaggccgtggaacgcgaccgcgctccatttgcgcgcacttgagaacggcacgcgcaccaaacctgcggaaccggagaagccttgcttgccgagcccctccaacaccgcgcgtccggtgccgttggggctctcctcgttggcgaggtcgtatagcgcctgcatcgcatgttgtttgttccggcaacccggcagcgctatgaaatcgtcgtacacgatgccgccgtcggtgatcgtgcccgtcttgtcgagattgagcgcatccacgcgtgcgagggtctccaccgagtcgaggtcctgcaccagcgtgttcttgcgggcaaggcgaatggcggcgagcgcgaaattgagtgacgtgagcagcacgagcccctcgggcaccatgcccacgacgccggccacggaggagacgacagcttggcgccattctccggtcgcgatggcgttgtgccagccgccgaccgtgcgcatctgcgtgacaatgagcagcatgcacagcggcaccacgaggaacgtcatgaacttgaggatcgtgttgatgcccttgttcaggtcggagacgttcttcttgtacaccttcgcctgagcggtcaacgtggcggcataactgtgggcgccgaccgcggtcaccttgacgagcgccatgccggagacggccgtggaacccgaatacacggtctcgccctcctgtttgcgcacggtgcgtgactcgccggtgatcatggactcgtcgagctccaatccccaggtatgcagaatctcggcgtcgcacgggatctgctcgccggagcggatccacaggcagtcgccgagcacgatgccgttatgcgggacgtccacatccttgccatcgcggcgcacgaggtaatcggaggcgatcagaatggagagcttgtcgagcgtgcgcttggcccgcaactcggtgacgatgccgatgccggtgttgatcaggatgacgaggccaaacaccgcgtctttccacgaaccagtgatgagcaccatgaccatggcggtgaagatgatgccgttgaacaacgtgaacacattggcgcgcacgatatccgccagggaacgcgacgtcgacgacttcacctcgttcgtctggccgcgctccacacggtcgcgcacctcggctgcggtgagccccttctcggtgacgtcgggcatatgtgcatggtcgtcgccaccttgcgcaccggtcatcgatacgctctgctgtgcattcgcggaatcgctcatgttcgccagtctactcaaccgtacgcacgcaggggaatacgccggtggtcaggaacgcgtgctgacgacgatctcgcgctcatggggatggtcgaagatcaccgaacgcaacgcctcccccatgggctgcgcgtccatcatgcgatcgttgacgacgaaggtggcggcgaacagcttggtgtcgccgggcacatcggccggattgagcagcacgaccggtatgcccgcattgcgcgcgttggcgagcgccgtattccactgcgactcgtcgtcatggaaggtgagcccgctgatgacgatgaccttgggatgacggctcaccgcatcgctcaccgccttccgtgcgaaatcggcggcgcgttgcgggtccgccgagtactgctgcacaccggtgtaactcgccttgaactccttggtggcgagcgagcgcatcaccagctcatccgcgccaccgtgcggcgagccaatcaccgcgacgtccagccgcgcaccggtgttctcattgtggttgtgctcataggtctcgttgttttgcgtgtcccccaccgccgcacctttcggcgtgcagccggccatcagcgccagcgccgccacagcgcatgcaatggccgccagccgtttcgttctccgtgccatgttcctcccgcctgccgcgcttcccgtgcccatctcacccagtcgtagctcgggtgccgtgatgcatatagcgtagcgtgatttcgtcatatctgcgcaaatctgcgacagaacaacgcatatcggcgtcctatttcgccaaatcaacgcagattggcgcaagtacgacgacaatacgggcatcttttcgtccgtgtaccgccaaagtgcagcgatatgacgaaaacagcaggtctcagcgaatgcaagcacagattcgtgcctgtgaccgcgacgagccatggatacaagcccgcaccggcacggcaccgccggcagatacgcgctctctcctctcatttcacgaagactgcgacggtctccacatggtgggtctgcgggtagatgtcgaaggccgcgatggagtggatccggtacccatgttcggtgagcgtcgccgtgtcacgtgcaagcgaggccggatcgcatgcgatgtagacgacgatcggcgcaccgctgttcgcgatcttatggcacactttggccttcgcgccggcacgaggcgggtcgagcacgacgatgtcgggatgcgcgcgttgaggatcgatgtccttgtcaagcgtgtgcagcacgtcgccgcacaatgcctgcacggtgtggattcccgcgttcctcaggttccggcgcgcgttggccacggcgtccttcgccccctcgatgctcacgagcttggcacggtcgtcgagcagtgtggcgaggggcagcgtgaacaggccggaccccgaatagagatcccagatgaccagattgcgcccattgcgcggtgcacggtcgccgggcgtctcacgaatctgatcgatcacatactgcggaagcaccatcggcgcctcgcggtgcatctgccagaatccgccggcatccaccgtgtattcgaacggtttgccgtccaccatgatggtttccttgagtgcgcggctgccgtgacgcactttgccgtccaccatgatcgcatagttcctgccgattgccttgcgcaacgcttcgggatccgcaatctgctcggcatccacgcgcggttcgggcacggcgatgcgaatctgcgcgttctccggcagattcccgtcccacacgccgttcatttcggcgacctcgagcacggcacgcgtcgccagtggcatcgtgtcgatcggcacccgcacatgggtgccccggcggcgcatcgacgggcgcccctcgtcgtcggtgaccatctcgatgcgggtgcgccagtgaagaccatgcgcctgctcatcccccggcatcgcatatacaggcacatcatcaaggtcgacatggcctagacgcttcatcacatccttgagggtggcttccttccagcgttcctggccttccaaggacacgtggatgagatcggcgccacctgctccccctcccatcgcaagtggtgccgccaacggccatagcggctccacgcgatcggggctgggttcgagcacctccaccacctcgcctgtccagaaccggtcgttgcggttcgtgggttcgtcgagttcgatgcgcacacgttcgccgggcaacgcgaaccgcacgaagaccactcggccgtcaatgtgcgccacgcacctaccctgatccgcatatcgctcgatgtccaccgtggcttccatattccgcctttccgctcaataccaaacgaacttaagagtaccgcatgccatacatacgcgagggagcccggtattgccggactcccccatggcccactgtcgatgtgccgctgctattgggcagtcggatgtgcgtcgccgccctcagtacttgtggattcccgctccttctcgagcatgcggtgacggtgcaacgggtcggcgacgatgaggtaggagatccagatcgccagcgcccagaacggaatgcccatgaccagcctcgtggtgccgagccaccccacctgattcgtcatgtacagtggcacctgcacgatgaggcgcaacgcgaacaggcctatccacagccatgtgatccgggcatacgccttgtagagcgccctgtcactgcgccagccgctgagccaagccttgaaatgctcggtgggcagcgatcgtatgaactccacgaggaacccgagccccggcacccgtaccgccatcgagacgagcagcagcacaatgtaggcggcgttcgtaatgaacccatacatgtagtagttgcgggcctcgccgctcttccacgcccagaacaggcatatgccgacggcgacgagaccacccaacgcgcccatgaccgactggcgttgaatgaggcgtacgaccacctgcaccacggcaagtgcggcggaggcgatgaccgtcatacgcagatccgacgtgcagatgaacagcacgacgaacaggagtcccggaagcatcgattccacgacgccacgtacaccacctatggcggcgatcaccgagaactcgtcgttctcccccgcattcgccagtgccgccatgccgcttcgtgcgcgtgccggccgggtgttggaagcgtgtcgctcgttctggttgctcatgacctcgttcgtgggtgttggtccgtaaatgtcggatagatgagatgagtaggcgttgctaggtgccctcagcgcacttcggagaacatcgggcctcggcgcaacgtggtctgctgctccacttgctgatcagtggacaacgggccatccggacggccggggatcttcgagtggtcatcgcctgcgagatcgccatcctcctcctgggcggcgagcgcacggcgttcattcggcgtcagcggacgggccatcggaatggggtcgcgcggcgacaacggctcatcgccgcgctccaccacaatctgtgcgaaggcatcgttgaggatcttcgtctcggtgccgtcggggtcggaggcggccttgccggagaagatacccctcagcatccaccgtgggccgtccacaccgacgatgcgagtgtgggccgtcttgccattcggcagcttgaccggcagcttcacctcggtgccgaaaatgccgtccacggcctcggcctccggattcgatgccagcaggtcctcgcgcacgtcgtcccacagtcccatcgtcttcggggcggcgaaggcctcgacctccaggctcgaattgccaatcgtcatcgtggcccccacaatctcatgggtggcgttgttcgccttgatgcgcaattggatgccctgcacgaatggcagatagtaggcgccaagtgagaggtactcgtcgtaatcgggggcgttcgcgtcatccacatcccacgggccgaccgtctcgccacggccctcatagtcgacaccgacctcggtgcgggcgccctcaagtacctcagtctgctcgtcgtcctcgctgtcttcgacggcgacgtcctcggtccgcgagtccaccgcctcggccagacgctcgtcatcctgctgctttttcttctttctgccgaatccaaacaagcccatcatgcctccatgcaagacgtataccaatcggtgaataagctgtgtccaacactagcacgcgcactggcaatgcacgtcaaatcaggccatcccacgcccaatccacacacatcgaccctgcacgctgcgcctctcatacgtcgtagctgatcgtcagcggcgcgtggtcggaccaccggctgtcgtacgacgatgcgcggtccaccacaaagccgcgcgcctgctgggccaattcgggagtggcgaattggtagtccaagcgccatccggaatcgttgtcgaaggcacgcccgcgctgcgaccaccaggtgtaggggccttggatgtcgccggcgagatcacgcatcacatccacgtagtccatctggtcgatccacttgtccatataggcgcgctcgcgggggaaatacccgttgttgttctcattggacttcgggttcttcagatcgatcgggttatgcgcaatgttgaagtccccgcacaccacggcctgcctgccaccgcttgccgcctcatcctgcaactgctgcatgcgctcggtcatcgtgtcgaggaaacggtacttctgcgcctccttcgggtcgtccaccaagccacccgcatgcacgtacacgcacacgacggtgatcacatacccctgttcggtgcgaacatccgcctcgatccagcgccccgaatccacgtcttcctcgagtccgggcaatcccacgcgtgtttcgagcaccggcatgtcgctgatcatgcccacgccggcgcgccccttgattctgcagacgtccaccagcgtatgcagttcctccggcgacgcgatcttgccggcatgcacatagtccgccgcgagctcgccgtagatgtcggcgatgatctcctgaggcgcgcgcgtctcctgcatgcaccagacattcggcgtatgcgccttcgcccagtggtcgaatcctttgcgtttggccgcacggatgccgttcagattcgaggttgtgattgtcaaagccatgcttaaagcctaccagcgcgcgcaacatatggttctggcgaacaggtttcatgcggtgtttcacataagctgacatatgaaagtcccctcgtcccgctcccaacgaactactgtgtgagctgggcgatgcccacacccgccatcgccgtgctgttcgattactgggagtggatatgaccaaaccaaccgattcccctgccgccaagctgcccatgccgcgtggattcaagctcttcattgcgctcgccgtgctcatggtggtcggcgccgccatctcgctgttcgacaaaagcgagttctatgcggacgtgttcatcgagatctcagtattctgcgtgttcctcgccggcttcttcacgaatacacgcacactgcagttcgcctatctcgtcggggcgaacatctatgtgatcgtctgtctgggcgcattctccaccgtgttcttcacgaagatgaatcagggtgtgggcgtgctgctgatcatccagatcatattctcatgcctgaatcttgtgccgatcatcatctaccacctgaccgaccgcgaattcttctatacctaccaacgccagctcatctaccccacgctgttcttcgtgttcgtgctattggggcatctgccaggcggcgatgtactcaccagcgaggtctcgcacgagatcttctccctgatcatcttcgcgcaggcattcgagatcatggacgcgattcacaaggtgggcaaggcgcaccatatggccgcctatgcgatcaatacacagccgctcggcacgaagctggttcccgataccgatgatgcagatgattccgagggctccctcgacgaacccgaggatgtcgaggaatagacttgcgtaaaaggagacagattaagcaagaatctgtcccttttacgcatgattatctcgtgtgtgaacaccttgtgtgcaagtgcccctcagcgtaatcagcgtaaaaagagacagttccggtaaggaaattgtctccgattacgcaactaaccgtatgcactcccgtttgcgtaaaaagagacagaggcccatagagcaacgacccgcggcacgcagattatgcgggcagcgggtcgttgtgtatgttcaggattgctcaggccttgtcttcaagattgagaccgagctcgagcttgccgcccgggatggcgtcaagcaggtccttggtgtactgctgctgcggatgcaggaacacctcgtcggtggtgtcgtgctctacaagcttgccatgctgcatcacgaccacgtcgtcggcgatttgacgcaccacggcgagatcgtgcgtgatgaacaggtaggtgagcccctgcttggcctgcaggtcgttgagcagatgcagcacctgatcctgcacgagcacatccagggcggagacggcctcatcgcagacaatgacgtcggggttgagcgccatggctcgtgcgatggcgatgcgttggcgctgaccgcctgaaagctcgttcgggtaccgtgccatcaccgactccggcaactccaccatgtcgagcagttccttgacgcggttgaggcggctcttcttgtcgccgatcttatggatgcgcaacggctcctcgatggaacggtaaatcgaatacatcgggtcgagcgagccataggggttctggaataccggctgcacatgacggcggaaatccaacaggctcttgcccttgaactcctgaatgtcctgaccgttgtagagcaccttgcccgaggtcggctcgagcagcctcaacaccatgttcgccacggtggacttgccggaaccggactcgcccacaatggccagcgtggtgccacgacgaatcttgaagcttacgtcgtcgacggccttgaacatctcacggcgtcgcggcagcttgaattccttggtgagatggtcgacgtcgatgatcacgtcgctatgctcgagcttgtcttcgtccaccttgtgatccatgagcgaggtggcgtcctcacccttctcctccacggagatgatgcgctgcgaggccaacgatggggccgcggccaccaaacgcttcgtgtaggggtgctgcgggttctgaagcacttcgagcgaggggccggattccaccacctgccccttgtacatcacgacgatatgctgggcgcgttcggcggccaggccgagatcgtgcgtaatgaacagcacggcggtgccgagcgagttcgtgagctcctgcaggtggtcgagaatgcgcttctgcacggtcacgtcaagggcggaggtcggctcgtcggcaatgagcagctcaggacggcatgccaagccgatggcgataagcgcacgctgtcgcatgccgccggagaactcatgcgggtactggcgtgcacgcgtggcggcatcgggcagacctgcttcatcgagcaggcccgcgatgcggtcggtcatcgtggaaccggtgacgtatttcttggcgatgtaccaagcgtcgtcatccttcacaccgcttttgatgaggtcgtcggcaacacgccagcgggtttcggaacccggcacccactcctcgcggaaatacgccatgcgcttctcgtacttgccgccttccacaccggccttgaccagggcctgcccggccgcttcgagcagctcaggcagctccttggaaccgaggaaggtctcatcgccctcgcttttgatcgtgatgtcggcctgggccaatgccttcgacaggttcgaacgcttctcgtgggcgacgtccatatggttggccgtcaacgcctccttgacctgggtgccgatgcggtacaccgggttcagattgctcattgggtcctgcggcaccaaacccatcttcgaaccacggatcgaagcgaactgcttgggcgagtattggctgatctcttgcccttcgagcttgatcgaaccgcccaccacatggccggtacccggcagcaggcccaggcatgccatggcggaggtggactttccggagccggattcgcccacaatggccacccactggcccgggtacacgctgaacgagctgttgcgcacggcgtggatcggcttgccctcatcggtggtgaagtccacctggaggtctttgacctcaagcagcgggcccacctcatgctgcatgtcctcgatcttctcttcgatcgtctcctgattggactgtgtctcgtttgtcatcgatgtctcctgtgcgctcatgcggtacggctcttcggatcaagggcatccttgacggcatcgcccatcatgatgaacgcgagcacagtgatggccaacgccagcgacgggtagaacagcaccatcgggtcggtgcgcagcacggtctgcgccttcgagatgtcaccgccccagctcaccacgctcggcggcagaccgatgccgaggaagctcagcgtggcctccgagacgatgtaggagcccagcgacgtggtgccgatgacgatgatcggtgccaccgagttcggcagaatatggcggaacagattgcgcatcggcgtggagccgagcgccgtggaggcggtgttgaactcgaggttcttcgagctcaacacggcgccgcgggcgatacgtgccgtcgagacccatccgaacaatgccagcacgagcacgaccttccagattgacgagctcgtacggaacatctgcagcacgacgatggcgccgagcagcatcgggatggccaggaagatgtcgaccagacggctcagcaccgcatcgacccatcctccgaagaagccggcgatggcaccgatgagcgtgccgacagccacgacgatgatcgtggtgagcacgccgacgctgatcgaggtgcgtgcaccatagaccacacgggcgtagacgtcgcagccctgcaggtcgaagccgaaggggtggcccggctgggagccgtcgagggaattctcgagattgcagtagttcgggttcgtcctggtgaacacccccgggaagatcgcaacgaacaggatgaacaggatcacgattcccgagatgatgaacatcgggttcttgcgcaacgtacgccacgcatcggcccacatgctcgtggccggtgcggattcatccacattgtccaccgaaagcagcggggtctcatccaggggggcgacaaagcgctcctgcccaggcaacggtttgttggtgatgtcagtcatgtccctccctccttcacacgtagcggatgcgcgggtcaagcgccgcgtagagcatatcgacaatgagattgcagatcacgaacacgagcgtgagcaatgtgaccaccgacaccacgagattcgcctcgcctttgaggatgctctgataggtgagatagccgataccatgaatgttgaagatctgctcggtgatcatggcaccgcccatcagtgcgccgagatcctgacccaggtaggtgaccaccgggatcattgaattgcgcaggatgtgacggaacgtgaccgcggtgttgctcatgcccttggcacgggcggtgcgcacgtagtcctgtgcgatgttcgacgagatttcggaacgggccaggcgaatgatgtacgccatggaaaccgacccgagcaccatggccggcagcagcaggtcgaagaagccagggtccgcgcccgccgtcaccgggaagatgtgtcccttgacgccgaggaagtactggccgacgaagccggtgacgaaggtcggcaccgagatgagcagcagcgagacgatcaggatgaccgaatcgtaccacttgcctttcttgaggccggagattgcgccgaacacgcagccgaagatcgcctcgaagcagaacgccatgagggcgagcttcaaggtgaccgggaacgcccggcttatctcgtcgatcactggctggccggcgaatgtgttgccgaagttcagcgacaatgcgttcttcaggaacaacagatactggacaataaaaggcttgtccaaattgtattcactgcggatctgggctgcgacggcctcattgactggcttgtcgccgaacatcgccttgactggatcgcctggcagcgcgaatacgagcgcgtataccagcaatgttgtaccaagaaccacggggatcatctgcagaatacgtcgcagaagatacttgcccatcggtttctccttgcaaattcaatgccggtgcaacgcggcgaactcgacacgccagcggttgcatcggttattcagttcgtgcctagtttaccgcatgcgttgacttacgtcgagaagaagatgccccatatgggctatgggaggtgtggcccgccacgtaaatcacagtggccttctgcctgcaaccgaaatacaagaagagggcgaaaccaatggtttcgccctcttcccatggatggtggctcatgtgctcacacaattgtgaacaaattgagcatcacttggacatcacctggacatcacttggacatctcttcatagatgggctggttctgccaatccatctggaagttcttgacgcccttggctgccacgccgtccgcattggaatagtacagcgggaacgccggaagctgttcgagcaggatctcctcggcatcgtggtagtacttgatggccgtttcctgatcggtcgccgaagctgcctgatcgaggagcttgtcgacgtccttgttcgagtagtcgccgtcgttggagccgtgaccattggccgcagcggtgtcgtagagctggtacaggtagttctcggccgacgggtagtcaggctgccaagcggtgcggaaggcacccttgatcgtgcggttcgaaatggcgtcgcggaactcctggaaggtcggcatcgggttgatcgaggcctggatgccgagggtgttgttcacctggttcaccacggcctcgtagatcggctgagcgccgccatcggcgttgaacgagaacgtgagcttgccgtcgtacttcgagatcgcgtcggccttcgcccacagctccttcgccttggtcgggttgtacttgaggttgtcggagcccttgagatccttcgaatagcccgggatcaccggtgcggtgaagtcggtggccacggtgccgatgccattgagcaccttctcgacgatctgctcacggttgatggccatcgagagggcctgacgacgcagctggccttcctcggtgccggtcttccagtggtcgaggtcagccgggatggtgaaggtctgaatcacggagccggccttgttgtaaggctcaacatccggatcgctctggaaggtcttcgtgttagaggccgggacggtgtccatcacatcgaggttgcccgcctgcacatcggcgtacgccgagtccggggaagtgtagatcttgaaggtgacgccgttgttggcgaccttctgcgagcccttgtagtcggcgttcttggagagcacgatctgcttgccgtgatcccagctgtcgagcttgtacatgccgttgcccaccggcttctcgccgaaggccttcgggtccttgtagaacgattccggcagcggagcgaaggccaggtagccgatcttgactgggaacaccgaatcaggcgcgttgaggtcgacggtgaaggtcttgtcgtccttgaccttcaggccttcgagctgctcgtcacccttgagggagttggcgtcctgcagcttgtcgtagcccttgatcgagctgaagaaggaggagcacttctgggcgttcttcgcattggccacatagctccaggccttggtgaacgactcggcggtgaccggcgtgccgtcggtgaacttccagccgtccttgagcgtgatcgtgtactgggtagagtcggcgttcggcttgatcgagtcggcgacctcgttctccgcctcgcccttggcattgaaggcgatgaggttggcaaacagcagctggcccaccttgccgccgccggtctcattggtgtcgcctgggatcagcgcgttctgcggctcggagttgtatgcggtgatgatgttgtcgccggagcccttggccgagctgccgccgttggaaccacaggcgctcaggctcagcatcatgcccagtgagcagatgccggcgatgaggccgagtgtcttcttcttcatggtatctcctattcatatgcagacgaatactcgcctaatagcagcggggctgaaggtgggaccctcaaccccgttgctgattacccatcattattgccacacctcccgtcaaatcaaaatccgcagcagattcattccatcgatacatctcatttgcgcatgcgttgcaatacgcgcatttgccgcgaatccccgtcaattcacgtgggaggcgtacgccgctacattgttaccgatgtgttaacaagtgacgccgacggtccggggcaatgcgccctatgctcggggaaaggcctgcctatagcggtccttgagctgttcgatcgagacatgcgcatatcgttgcgtggtctgcaacgaggaatggccgagcatctcctgcacctcgcgcagatccgcacccccgtcgagcatatgggtggcggcggaatggcgcaacgcatgcggcgagatgtcaggcacccccgcctgctcggcctgctcatgcaccacctgacgcaccacacgctggtcgatgcggcacccacgtacaccaatgaacaccgcgttgccgctgttcccattcgcgaataccggccttcccccgtgcagccagtgctcaactgcctgttgtgccggagccccgaacgggatgactcgcgtcttgttccccttgccgagtacacgcactgtgcggttcgaccagtcgaacgagcccatgtccaatcccacgagttcgcccacacgcatacccgtggcatacagcaattccagcatcgcacagtcacggagcgcctttgcatgagcgttcaaggcgtcgtccttcgacttgcccgcgttcttctcccctgcttcggcatccacggtgtccatcagtcgttcggcctggtcctcgttcaacacggccggcaggttcctgtcgattttcggcgtgcgcaatgcatgcgccgggttgtgggcgagcatcccatgctcataggcccaggtgaagaaactacggacggctatcgttttgcgggcgagcgacgtcttgcccacggtatgcgccatgcgccccatccacatgcgcaggtcgtcaagcgtgacatcgtcgggattcccacggccgaaggcatcgagcgcttccaggcactgcagaatatcgccgcggtacgccatgcaggtgtgctcgctgagtccccggttggagcgcagatattcgatgaatcgctccatcagcacttgcgcatccatggcaccttccatctcgtgagattgtgcgatccagcataccctgcttccggtactgtggtctgtgcaaacgaccctcatccatgaccatattcgactcatatggagcggtcgtgcagtgaagatgaaggggcctgcgccgttttgcggggcagatatcgcgccgtgccatgcacatatgcagattggcgcatcccacccatcggataccgggcgacgcaagcccggtggaaaggtttccatgagcaaacaagcccgcacagtcacaaatcctgacgacccggtcgtcgcccgcgcagtcgatctggtcaagacctacggcgatacggacagccaagtgacggcgctcaaccatgtcagcgtcgaattccagcgcggcgagctcaccgcaatcatggggccgtccggatccggcaagtcgacactcatgcactgcatggccggattggacgtgccgacgagcggacaggtgttcgtcgaagacctcgaggtctcgtcaatgaagcagaagcagctcacccaactgcggcgcaaagagatcggcttcatcttccagtccttcaacctcgtgccaacgttgacggccgaggagaacattctgctgccgctgcagatcgcgcaccgcccggtcgaccgcgactggttcaggaaagtcgtcggcgtcgtagggctcgaaaaccgcctcgaccaccgccccagccagctctccggcggccagcagcagcgcgtcgcatgcgcccgcgcgatgatggaacgtccgagcgtcatcttcgccgatgaacccaccggcaacctcgactcccgttcgagccgcgaggtgctcggcttcctgcgccaatgcgtgcaggactatggccagtcgatcgtcatggtgacacacgacccgcgtgccgcgagcttcgccgaccgcgtgctcgtgctttcggacggttcgatcacgcaggatatggaccacccgacctacgacgacatcctcgccgtcttcgccgagcacgacgacccggacaacggcccggtcgacgtcgagcccgcagccagggaggcctgagccaacgatgttccgtatcggattaagggataccaaggcgcatttccgtcgcttcatcatgtcgatcatcgcgatcgcgctcggcgtcgcgttcgtcgtcggctcgttctgcttccgcgagatgctcaacgaccaagtctcgcagatgatgggatcgaattcggacgccgacgtctatgtgcgcggcgcgaccgaggagaagcaggagccgggtggcagtgtcaccagctacaacagcacatacaacgaaatcagcacaagcatcatccccgacattgagaatgtcgacggcgtcgcgagcgccgatgcgacgatgcagctgggcaacgccgtgctgctcgaccacaacggcgacgcgctgacgacggtcggtgcaccgacgctcgtcatcggcgtcgatcaggacgccccatggcgttcggcgcatttcgtctcgggcgaatacccgcagacggacgatgaggtcgcgctgcttgaagacacggccgacaaagccgggctcaagaccggcgacacggcgaaactcatcgttgacggcgaggcacgtgagatgaccgtctccggtgtcttcacttcgccgtcgacacagctcggcgcaatcctcattctcgcccgcccgagtttcgtccagcatgtgctgcaggaggagggagaggacacctcgagcatccagttcatcggcgtgtacggcagcaagacgacgccgctcgacgaggaggcccagcagcaactcgccgaccgcatcaacaaagcactgccgaagagtgcggacgcgcacgccgtgaccggcgactcggtgcgtgacgacgcgacgaagagcatccaggaccagctcggcttcatccagccgctcatcctgatcttcgcggcgatcgcgttgttcgtcggcgcgttcatcatcgcgaacacgttcacgatgatcgtgcgcgaatcgatgcgcggttatgcactgctgcgttcggtcggcgcctcgccgttgcaggtgttcgcaagcgtgctcatccaggctgtcatcctcggcctggtcggctccggcatcggtgtgctgctcggctggggtctgctcgaattgatcgcgaagggcatgacgcaaagcggcatgccgctgtccggctcgcccaccccttcggcgaccgatgtcatcgtcggcgtcatcgtcggcgtcatcgtgacgatcatcggcgcgacattgccagcgaagaccgcggcgaccgctcccccgatccaggcgatgaacgagacggtcaatccggagaagccggtcagggcacgtggatggattggcatcgcgatggtcgccgtcggcgcagccttctgggtgctgtgctatctcgatgcggacaaacgcgttgattggcagtggctcaaggacctcggttccggctggacgctcggccttggcgcggcattcgtcgtcatcggcgcaatcgtgtgcgcgccggcgttcgtcgcgcccgctgcgaaagtgctcggctggatcccgtcgaaggcgttcccggtcaccggcaagctcgcgacgcgcaacatcggccgcgcgaagcgccgcaccgcgaacacggcggccgcgctgttcatcggcgtcgcgatcgtcagctgtctcggcgtcgtcgcatcctcgatgaagacctcggtgagcgacctcgtcgacaacaacgtgaacgcggactacgtggtcatggcggcgagcatgacgcaaccgatctccacgaaggccgtcgacgcggtcgaggacacggaaggcgtgggtgcctcgtcggccgtctccatgctgcccacggtgaaggtgacgaacgccacgaagaccatcatgccgaccacgagcaaggtcgatctgttcacgaagatcgcaccggtcgaacgacaggatggcgatgccgcgaaggcgatcgagaacggtgaggccgtgatcggccgtaccgtcgccaatgatgagcactggaaaatcggtgacacgattgatctcaagtccgaaaacacatcggtcgacgaacaggccacgaagcaggcgtacgaagcctaccagaagaagatcgaatcccaagtgacggcactgcagcaggaagcgcagcggcttgcctcctcgggcgacgtctccggcgctcagagcaaagcgaaggaggcggagagcatcgtcaagcaggcgcagaataccgacccgaagcagttcgtcaagatgaagaccgagacgaagaaggagcaggtcaaaatcggcgcaatcgtcgatgacgctctgtactccgacggcatcatgatctcgctgccgactgcggagaggctcacgagcaaagacatgatgatggtcacgcagatgtacgtgcaggcgaagcccggcgcgaacatcgagcgactcggcaagaacctggagaaggccgtgaagccgttctacacgatctcggtgctcacacgcgacgagttcaagtcgtcgatgagctcgatgatcaactcgatgctcgcgatcatctacgcgctgctcgcattgtcgatcatcatcgcgatcttcggcatcgtcaacacgttggcgctcaacgtgtcggaacgtacaaaggagatcggcctgctgcgcgcgatcggcacgtcgaacggccaggtgcgtggcatgctcgcgatcgaggcggtcatcctctcggtgttcggcacactggtcggcatcgtcgtgggtgtcgcggccggcgtcgtgattcgcatagcctacgagtcgcagggcatgacgacgttgacgatcccgtgggaccagctcgtgctgttcctcatcgtcgcgatcctcgtcggcctcatcgccagcatctcgccggcaaggcgcgcgctgaagcaccccgtgctcaacgcagtcgccagcgagtgacggaaacccggtcagcagtggctgggcccggtcaatcgcacgattggccgggcccagccgttatatgcactccccgaaggccatggcacgatgtctgcgcagcgttgcatgttgggagggcatcgttttcgggaaggagcgcgaatgagattgccggaacgaatcccggtgggagcgcgcgtggtcgtgcgcatcaccgatggcgtcgacgagtacactggtcgacaccagtaccgtgactatgtgggccatgtgcgtgcgtgggatggcagaacactgcagctgacgcgcgatgccgcggcgaacggcagcagacccgcacaggacgtggatatatcggcgaccgacatcgccattctcaaaccggtgccagagcgcccggctgcccgtagatgagcagccagcaacacgtcaggagcgaatgctcggatgctgctcggcgatcaggcggtgcccggaggtgaagcgcacaatgtactcaccccgttgggcggatttgagcagctgttcgcgccaatgctcagggtcgatgcgcagcgactggaagatggtctcggtgctgtcgctcaccttccccgcattgatctgcgccttgtagtcgcgatatggctgcccctcggcgaagaaatggcgaatctcggtctcgtcttcctcatgcagggcattggcgaactcgctcagccaatcgatcatgcgatgcagcagttcctccacattatgcgcgttctcgaccaccatggcacgcgtgcgatccgggtcggtcaatgccacgcgggtcatgtcgcgccaagagccggcagaaagtgccgaggcgatggcgttgttcgcatcgctcgtcatctcgttgatgagcgccgtggacagcacatgcggcatatgcgagatgagcgacgcctcgcggtcatgggtcacatcgtcaatcacgatcatcgtgttgcgcacgccgcgtgtgatcatgccggcgatctgcacaacgcgccggtactgcgtgtgcagaccgaatgtgaccgcccacagcgcgtcatcgaacagtgtggggtctgcggccacccagccagaatgctcgttgccggccatcggatgcgctcccacgtagcagtcaagcagaccgacttcgcttacctgtgtgcgcacgggccccttcaccgaaccgacgtcggacagcgtggtcttctgtggattgatgatcggtttgatcgtctgcagcacctgcggcatcgccacgagcggattgcacagcatgagcacatccggctcctccgccaccagctcctcaagcgtgtccttgcaatcgatgccggccgcacgagcgttcgcatatgggtgatcgcgatgattccacgcactcacatggcagccggactcacgcagacggcgtgccagcgaacctccgatgagcccgaggcccactatggcgacatgcttggggcattcgatgccctccggtgcgatttggggttcgccggcgttgtcgcgatcccactgcttgatcgtctcctcgtgcatatcccgctctaccacagcaattcctttcgcacatctgcgctctcacgccaattcgccatgtggggttcaccttcaaatcgtactccacctgcaggaagcatccattccgagaccgttgggtagttacgctcgtctcgcgggtagaccgccagcgtgcgcacccagtcgccgtgctcacatatctccaccagtgcgttcacgaaccgttcatcccacggtgccgcgtcgagcgtcgccaggaagctgtaagtgccgtcgcgtcccttaaccggccgcgagatcaggctcaccatgttcagttgcgcgtcgcgcagcacgtcgagcagattcgcgagcacaccgggccccgtcaccagcggaatgaacgcgatgaccgattcaaattcagtcttcggatcgctacgtgggattcgcaaccgctccaccacctgactgcgcggggcgatcgtgaggaactcggtgcgagcgccgtcgaaatctcccacattggccgccacgcggtgcagaccgtagatgttggcacagatcgaggggcccaatgcaatctggaagtcctgaagatcgcgacaggcggcggcattcgatgctgcgggaaccggtttcagtccatgctcgcgcgcgaatcgccggcattgtgcgagtccgtgcgaatgcgcgcagaccgcggtgcaatcgcgaatcgcaagctcgtcaatcgtgggcggcgttgaggcggcaccataggcattcgcattgtcgcgggcgggaatctgcgcatcgtcgacggcgatctcactggcatattgttcgcacgcatgccggtaggtgcgctcggtgacgaatgcgtcgaatcgcacattcacgcccacgcgcaggaaaccggcggcatcggcggcgtccatcatgaggtcgagattgggaaccacgaatccctcgacattgttctcccaggcgatggtgccccatccctgcccgagctccactgcatgcaggatctgaggaaccgtgtcgcaggcgacgaattcgaaatccgcgacgtccatatgcagcctacgtgatgcctcggcggcagactcaatggccgcctgatgcgtgaacgaaccctgcgggccgagataatggatgcgtgtggattgccgcgtcatggattccctcacctacctgccgtcagtcgtctgtgccggagtcattctcggatttgcgtctgcccacacgtcgcgtcggcatgctgaagaatctcctcgggaacacgagcagtagcaactgcacgacaacgacgccgaacagccagctgtagcccgcatgctgcgaccagaatggcagcgaatccgaggcgaatccggcagcgatgagtacgtcgcccgaacgcagtgccaggaaatacaacaccgtggtgctggcgatgaaatacaatgcgaagccggccacgccatccctgctgcgcgcactccatgcaccgagtgccacgagcagcaacgccagcaccaagccgtatgggatgttctgcgcggcacccatgcggtgcgcaaatgttcccacaatgccgagcgccgcgccactgaccacatcgatgaggtaacgcagccacggccgctgcctgtaactccatggcagcgcggactcctgcgcatcatcgcccgccgtgacgtattcggtgacgttcgtgttctggctcatggctccatcgtaggcgtcccgcgggatttcagggcacgcacatatatgcatatgcgatggagggcggcttgcaccgccctccattccgatcacatgcgcatcgccggcatcacttgttgttctgctgcgcgttggcgcgacgctgcttggcgcgccacttgtaccaatcctcacggccaaggatgatcttgcgtacacggatcgattcgggcgtgacctccacgcactcatcctcgtttgcgaagtcaagcgactcctccaggctcatcttgatcggcggggtgagcgtctcgagcacatcggcggtggaggaacgcatgttcgtcatgtgcttggcgagcgtgatgttcacgtcgagctcgtccggcttgttgttgatgccgacgacctgcccctcatacaccggcgactgcggttccacgaagaagttgccgcgggcctgcagacgctgcatggcgtatggcgtggccacaccctggcggtcggagaccatggagccgttctggcgggtcacgatctcgccagcccatggcgcatagccggccgcgatggaagacgagatgccggtgccgcgggtggatgacagcagtgcggtgcggaagccgatgaggccacgcgacggcacggtgaactgcagacgcacccagccggaaccgtggttcgacatcgagtccatgcggcctttgcgggcggccatgagctgcgtgacggtgcccatgtactcctccggcacgtcgatcgtcgtgttctccattggctcgcacagctggccgtcgatggtcttggtgaccacctgcgggcgcccgacggtgagctcgaagccttcgcggcgcatctgctcggcgagcacggccagtgccagttcgccgcggccctgcacctcccaggcgtccgggcggtcggtgggcagcaccttgatcgacacgttgccaatgagctcgcggtcgagacggtccttgatcatgcgggcggtgagcttgtggtccttgccctcggtgccggccaacggggagtcgttggtgccgaaggtcatcgagatggccgggtcgtcgacgtggatcagcggcagcgggcgcgggtcgttcggatcgacgatcgtctcgccaatcatgatgtcgttgacgcccgcgacagccacgatgtcgccgggaccggcggactcgaccggcagacggtcgagaccctgagtacgcagcaactcggagacgcggaagttctcgatggagccgtccacgcgcgacaggccgtaggtcttgcccttctcgagcgtgccgttgtagatgcgcacgagaccgagacggccgaggaagtcggaggagtcaatgttcgccacatgggcctgcagcggtgcgcccggctcgtattcgggggccgggatgttcttgatgatcgcgtcgaacaacggttccagattgtcgttgtcgggcagctggccatcggccggctggttctcggaggcatagcccaccttggcggcgcagtagatcaccggcaggtcgagcagtgagtcgaggtcgaggtccacaccctcctcgatcacatcctgcgccaagccaagcagcagatcggaggcctcgcccacgacctcctcgatgcgagcgtcgggacgatccaccttgttcacgcacaggatgaccggcagcttggcctcgagcgccttgcgcagcacgaaacgggtctgtggcagcgggccctccgaggcatcgacgagtagcacgacgccgtcgaccatcgagatgccgcgctccacctcgccgccgaaatcggcgtggccgggcgtgtcgatgacgttgatcgtgatgccctccgggtgaccgtatttctcggcaagcggtccggtgtactcgacggccgtgttctttgcgaggatggtgatgcccttctcgcgctccaggtcgttggagtccatgacgcggtccggcacttcctcgcgctcgttgaacacatgggactgctgaagcatggcgttgaccagcgtggtcttgccatggtcgacgtgagctacgattgcaacatttcgaatatcgccgcgaacagccattcaaagcctctcttgattattcctatgatgtgattcacactcaggcatacgtataggtgttgcgttgactcgcaaaccatcgcaatcgtactctcgcagtgtgacagcgttgtataattattcgtcctatttcgcctgaggagtggctcggcatatctttcaccagtctgtctgcacgtcgacgaccgagcttggcatatatggtcgttgagcgggcaatctgtccatagaacgaccatagtagagacaaaaaaggtcgtttacccacattgttgtcaggtaaacgaccaaagttggcatgaactatggtcgttcagtggacacagtctgcaaggaacgaccaagtctgcagattaatcctccagggattcaccggtacgctcgggcaggaacagcgcggcgacgcaggcgagcacgaaggcgacagcgaagacgatgaaggcgacggacttgttgccgccggacatcgtgaggaaccacggcacgagaagcggcgccacgatggcggcgatacggcccacggcggcggctgcaccggctgcggtggaacgcatgcgggtcgggtagatctccggcgtcaccgcgtacatcacaccccacgcacccaggttggaggcggagagcagcatgccgaagcacagcacctgcgccaccgttgcggattgcgagaacaggaacgcggcgagcgcggagacggcgaggaacacgctcagcgtcttgcgccggccccaacgttccacgaggaatgcggcaaggaagtagccgggcagctgcgcgatcgagatggcgagcgtgtagccgaacgacttcgtgagcgagccgaactggtctgcaagcagcgacggcatccaggtgaacgcaccgtagtacgagaagttgacgaagaaccaggtggcccagatcgccagcgtgatgccgaggtatttacggccgacgagttcgcgcatgcgaatcctacccagtttcctggcgggtttcgatggcacggcggcgacacccgaggcttgttcgaagtagcggacggaggcctctgcgcgttcgttgtcgccacgggcctcgaggaagcgcacggactcgggcaggtggcggcgcgcgacaatcgcatagagcagcgggatggcgccgatgagcagcgcccaacgccaaccccagtcgccggtgtttggaatcacgaaatagccgatcatcgcggcgagaatccagcctaccgcccagaacgattcgagcagcaccgtgatgcggccgcgctgcttggccggcgagaattcggagacgagcgtggaggcgaccggcagttcggcgcccagaccgaggccgatcacgaagcgtgccgccaagagcgcgagcagcgtccacgagaatgccatggcaccgttggcgagtccgaacacgatcattgtggcggtgaacaccgtcttgcggccgagcttgtcggcgaggaaaccgcccagcgcggcgccgatggccatgccaatgaagccgatcgacagcacccatgacttctgcgtggcgtcaaggttgaaatgcgggtcggcggcgatggcggtgacgacgaacgacaccaatcccacatccatggcgtcgaaggcccaaccgatgcccgacgccatgagcagtttgcgatgcgccttgttgaacggcaggcggtcgagtcgttcgttgcgtgtgagcgtggtcgcttcggcattggcgagcggctcgcgctccggtgaggggccgtcgatcggcgttgcggcgccgaggcccagttccgcggtggtcatagcactcctcggtttcttctctctgtgttctcgttgctctgtcctgtgttggatgcgatgcctatgcatgcggcatgagggcggaaagcgcgtcgtcaggcgtattcacctgcaaagcttcgcaagcaccatgcgggttcccggctacatgctcggcgaagaaggcgaagccctcctcctcggcatggtcggcgaagtgatacagcgcggcaggccgtctgcggccctcccgtgccacctcgccggtgtcttccaacgtgtgcgaggcgagcatcttgcggcggaaattcgccagatcgatctcctcacccagcaccgcctccaccacatcgtgcaactggccaagcgtgaacggctcggcaatcagctgccgtaccacattcggcgcatccatgcggtggcgcagacgccacagcgcatactccacgattgtggtgtggtcgaaggccagttcgggcagatcgtccaccgggaaccaacgcacgttgtgcgcattgcccgccgtgccaggctctgtgccgagatcggcatggtcgagcagcgcccagtagcacaccgacaccatgggaatgccgttgctcgagcgcattgggtccccgaatgtgtacagctgctccaagtaggtcgggtgcaggtcggtggtggaggccagcgtggcgaacgcggattcctcaagcgaacggttcgcctgcaaccgccctcccggcagcgcccacattcccttgaagggttcgcgggtgcgctggacgagcgggagccagagtcggcggcgcgcatgcccgtgcgtctccgattccaacgccagaatcaccgaggtgacgccaatctgcggcggggcgaatctccgttcgctcacattgccgtaccccatacctctcctatcggactcgtctgcctcgcatgcatccctatggcatggcagcatgcccggttgcatccaccccaagcatatcattaatagtcactatgactattaatatgtgtccacatggtggaacactgtttgcccatacaatcccgcggacaatgaaaaaagagaagaaggaaaagtggaggggaaggaaagtggaatcaggcgacgatgtcgcggtagatcatctcgcgggcgacctcgcggtactccttcgccgtcttgtggttgtgcgcgaagaacgtgatcggcgctgcggccacattggcgtcgggaagcttgatcgaacgcgagatcaccgagtggaacaccttgtcgccgaacgcctcgtaaatgcgctgcagcacctcgtcgctgtgcaacgtacgcgtgaacatcgtgacgagcacgccgtagatctccaacgacggattgatgcgcgactgcaccttctcaatggactgcatgagcagcgccacaccacgcaatgcgaagaactcggcggcgacgggaatgatcacgccgtcggctgccgtcagcgcgttcacggtgagcaggccgagcgaaggctggcaatcgatgatgatcgcgtcgtattcgttgatgatcggccggagcaccgaagcgaggatctgctcgcgccccacctcagtgaccagctgcacctcggccgcggaaaggtctatgttcgccggaatgatgtcgagcccatcgaatttggtgtgctgaatcacctcatgcacatccatacgcggattgaacaacgccgtgtaaatcgtgttctcaagcgcgttcgcattgatgcccagacccaccgtggccgccccctgcgggtcgaagtccacgatgagcacgcgcctgccgtactgggcgagcgcgccggctatgttgatcgaactcgtggtcttgcctacgccgcccttctgattgcacatggcaatgacccgtgcgggaccatgctgccgcaatggttccggcaccgggaaggtctcgtattcacgtccaagcagatcggtaggcatatcgttcactttaccagttcaataacacaagagcgcccgcatttgccccatgcaaacgccgcgttcactcactgcatatcagtgtaatgcgccgagtagattgcgcgctgcactacttcgcacggggatgcgaggtgatgtacgtctcgatcagcgtgtcctggctgacatgcgtgtacatttgcgtcgtcttcaccgaggcgtgcccgagcagctcctgcacggtgcgcacatcggcgcctccctgcagcatatgtgtggcgaaggaatgcctcagcgtgtgcggatgcaggggtttgctcacatgtgccaacgcaccggcatgcttgatgatctcccacaccgactgccgggtgagccgcttgccgcgtttgttcaggaagatcgcgctgcgctcgcgctcgcctttcgccttgttctcgagttccggtctggcatgctccacatacgcgcgcaatgcattcgccgcatacgtgccaaagggcacgagccgctgcttggcgcctttgccggtaagtcgcaccacttgcgcatccatgtcgacgtcggtgaagtcgagtcccaccgcctcgctcacccggcagcccgtggcatacatcagctcgagcaacgccgaatcacgcatcgacaccgcctcgctggcgtcgtcatgccgcgccgcatcgagcagacgctgcacctcgtccacggtgagcacttcgggcaatgtctccgcagatttcggcggacgcacgctctgtgagacgtcgtcggccaccacacgctcggattgcatgaaccggtggaacatatggatgcttgcaagcctacgcgccaatgagaccgcgcttgttcccgacttggactgcgcggcgacgaaatcctccacatcgttcgacgtgatggacgcggccttggcgatcccctgttcgccgagccaacgcacatactggtcgatgtcgttctcgtatgcctgcaccgtcgccgcagacaggccacgttccacatcgatatgcgcgaggaacctcgcctcgagcatcggcagctcgccgttcatcgccacgcctccttctgctccctaatcaatgtatctgtatatcagcatcttcggattgtcattgcgcgccagtttttccctgcgccccttctgcgtagaaagagacagattgagggcatcggatgtccccgattacgcaaaggggagccgcttacgcaaaaaggggaaccatcctacgccacaggccctcccctgcgtaaaaagagacagataggggggcatcagatgtccctaattacgcagaggcggagagattacacagcggcggggagattacgcatagccggagagacggcagaagacgctgattgcggcatgtgaaagaccccgccacattggacggggtctttcacatggagaacgctatggcgtcactgttgcggcctgaagctcaggcgttgaccggagcgttgacatcctcaggcagagcggccttggcctgctcgacaatggtcttgaaggtgtccggatcgttcacggcgagctcggcgagggcgcgacgatcgagttcgatgccggccagacgcaggccctggatgaagcggttgtacgtgatgccttcgttgcgcacggcaatgttgatgcgctggatccacagcttgcggaagtcacccttgcgagccttgcggtcgcggtagttgtagttgaaggagtggagcagctgttccttggccttgcggtacaggcgggaacgctggccgcggtagcccttggccctctcgagaactgtacgacgcttcttgtgtgcgtttactgcgcgcttgacacgtgccatgtgattcctctttccagtaaagctttattcgttgttgtcgatgccggtttcagccgagcaggcccttcatcttcttggcctgtgccgtctgcagcacgtcgtcacgcttgagtgcacggcgcttgcgagcggacttgtgctcgaggttgtggcgcatgccgctgccagcgtgcatgaccttaccggttgcggtgaggcgaacgcgctttgctgctgcggtctttgtcttcatcttcggcattgctgccctccttgttgttcttcgtgtttgaagattgctattgctactcgttgtcgatagcggcctgggcttccttggcctcctcggccttcgcctcctgcttggcggcgagacgagctgcctggcgtgcctggcgttccgcgcgggattctgcgccacgcctgcgctgctcggactgcgtgtgcaccttcttgcccttcggggccaacgtcatgatgatgttgcgtccctcctgcttcggtgcgtgttccacagtgcccaggtcggagacctcctcggcgagacgctgcagcatctccacaccgccgatcgggcgggactgctcacgtccgcgaagcatgatggtgaccttgaccttgtcgcctgcgttgaggaaacgctcaacgtggcccttcttgacttcgaagtcgtggtcgtcgatcttgaggcggaaacgaatctccttgatttccgcggtgctctggttgcgtcgcgcttcgcgctgcttgatcttctcgttgtacttgaacttgccgtaatcgatcagcttggcaaccggaggcttcgcattgggcgccacctcgacgagatcgaggttcgcttcctttgccaggttcagtgcgacggaagtcgcgatgacccccacctgttcgccgttcggtccgataaggcgtacctgggagacgcgaatctcgtcgttaatgcgtggttcgtcgctaatgatgactccattcctcatattgtgccggggacctctggatgtcatactcgcgccatggcagcagcaaaacggccttcgaagacctcatacatgcggtagacatgcaattccaaacgccgtttccgcatgcccatgcagatcggacgtcgcacctgccgtgccgtgacccgaaaccatgacaggtttccaggtgggtttcccactttcttgatttctcaagcctgttagataataccacacccctggaccaaggcgattccattgccacgcccgcacgcagccggcagactcaccagattcgcatgcgcttgaaaatctaccacggcaggggctttcattcagacatgcgccgcggttttacacaggcgcgcaaaaccgcggcattctacaatggggagtgagtattcgggtgcgcggacgatggcgttcgtgcacccccatacccggttcagccctcccccgcattaccatgggtgcaggaatcatatgcgtagcacggcagcgcaagtcgccggcaagccaagcggagggggtcaccacgaacaccgcatcccgaatctgcgtcgttttcggcgccggcgagtattacacgcgcccatattctctgccagagcatgcgttcgtcgtggcggcggacggcggctatgcccatgcgcgcgaactcggcgtgcatgtcgacgtggtcgtcggcgacttcgattccaccgaggatctcgcgacggaatccaccagcgatcccggtatgcgcacactcaggctccctcccgagaaggacgaccccgacatgctttccgcactcaaagtgggctggcggcatgggtcgcgtgaattccatatctacggcggtctcggcggccgcgtggaccacacgatctccgacattcagcagaccgccatcgtcgcctcgcacggcggcatcgcctatctgcacggcgacggccgcatcgtcacggcgatctcggacgccgcactgcactttgccgcgcacgaggtcgccgacacccagtacgtgtcggtgttcgcgcattccgactccgtgcgcgacgtgaccgagcgcggtctcaaataccgactcgaccatgcgacgctgagcaatctgcaagtcaacggactgagcaacgagttcatcgacggcgatgccgcgcagattgccgtaggcggcgggattgcgatcatcgtgttcgacgatcgcgcaccgttgcccgaactcgtcggcgcgactcctcacggcacactcggggaaccgagcacacacgtcaccgacgcgctcgcatagcgcgatatctcgcgaacagacatcacgggttcggttccgcgtagcatatcgagcgttcaaaccgagcattgggcgcctcaatgtgagacataatcgttcgccaacaattccaacggctttcggcgcgcaagcgggggcttgaagtcaagcaacgccggtagaatgggcaatgttggttaaccaagccagcaggtgctatgcatccgccggcatccccaagggagaactacatgacagtaaagattggtatcaacggctttggtcgcatcggtcgcctcgccttccgccgcatcttcgagctgcaggagaagggtggcgaagccgccgacatcgaggtcaccgcaatcaacgacctgacctcgcctgccgcactggcatacctgctcaagtacgacagcacccacggtgtgttcaagcacgttgacggcaccccggtcgacgtcaagtccaccgacaccgcgatcgtggtcgacggcaaggaatacccggtctacgcagagcgtgacgcccgcgacctcaagtgggttgccaacgatggcgttgagttcgtgctcgagtgcaccggcttctacacctccgccgagaagagccaggcccacctggacgccggcgccaagaaggtgctcatctccgctcctgccaaggacgagaccaccccgaccgtcgtcttcggtgtcaaccacgacattctgaagaaggacgacaacatcgtgtccgccggctcctgcaccaccaactcgatggctgcaatggtcaagctgctcaacgacaagtggggcatcaaggccggcttcatgaccacgatccacgcctacaccggcacccagatgattctggacggcccgcgtggcaacaagagcggccgtgcactgcgtgccgccgcgatcaacacgatcccgcattcgaccggtgccgccaaggccattggcaaggtcgtcccggaggtcaacggcaagctccagggccacgcacagcgcgtgcaggttccggacggctccatcaccgagctcttcaccgtgctcgagaaggatgccaccgttgacgagatcaacgccgcattcaaggatgccttcgccgattgcgcctactacggctacaacgacgatgagatcgtctccggcgacatcgtcggcgacacccacggtggcgtcttcgatccgacgcagaccgatgtcaacaccgttgacggcgtgaccatggcccgcaccgttgccttctacgacaacgagtacggcttcacctccaacatggtgcgcacgctcgagtacttcgccgagatctccgagtgagcttctagccaagcatcacgagcatgagggccccgcttccacgcggggccctttcgtatgccgcttgaatgccgaaccaaatactgccacctattgatcccgctattatcgcgatatttcaatatttcaatatttcaatatcccaatacctcaatcttgaatcttgcgtaaaaagagacagatggaatccgcaattgtctctttttacgcagggttgtgcctatgcgccttggtacgtctctgcgtaatcggggacagccgtgggctccatctgcccccttttacgtcggattgctgcttggatgcgttggatttctgcgtaaacagagacagatggagcccgcagctgtccccgattacgcagaatggacgccgtaaccagtctctctccccctgcccagctgtggtcctagactgatagcatgggtaagaagaagcggagggcagccgcgacgccggccatcaaacagcttgaagacaccaaggtcacgttcacaacgcacgaatacgaacacagcaacgacgatgctgacggatacgggctcgaagccgcacgcaaactcggctacgacgaacggcaggtgttcaagacgctcatggccgacaccggcgatgagcgtgtgatcggcgtcgtgccggtcaacggccatatgagcctcaaggagctcgcccatgccgtcggcgcgaagaaggcggagatggcggacccgaaggtggccatgcgtgaaagcggctatgtggtgggaggcatctccccgctcggacagaaaacgcaacataggacggtgcttgacgaatccgcgctcgaattcgatgagatactcgtctccggaggcaaacgcggactgagtctgggtgtcaacccgcacgatctgctcgccgtgctcgacgccaccaccgcaccaatcgccacacagaagaaatcgtactaatatcctcgttccctggcagtggggcaaccggtgacctttcgtcactagatcgcaagcgccctttacgttcctcaatgtcaccggctgccccacctcagggaacgtgcgaaagcggcggtgcgggggatggccggcgacgttgaggaacgtaagggagcttgcgacagtgacgaaatgtcgccggccatcccccgcaccgccagaggcagaccagcgtggtcggatgttcagcctcgtttacgcaatgccgcggggagcacgaaatgcatgttctcctcaatcgtctccaccgtgtcgacctcggtgaagccaagccgctgcagtgcgtcgatcacaccctgcaccagctcgtccggcaccgacgcccctgacgacacgccgaccgcagagacaccttcgaaccatgcggaatcgagctcgtcggcgtcatcgacacggtgggcggtgccacgtccgccaagcgcctcgttcgccacctccatgagccgcaccgaattcgacgagttcgccgaacccacgatcaccatggcatcggcctgttcggccaccagtttcaccgcggcctgccggttcgacgtggcgtagcagatgtccgagctcggcggcagttcaatccacgggaatctgcgctgcaatgcggcgatcgtgcccgtggtctcgtcgacgctcaacgtggtctgcgaaagcaacacgagcttttggtcgggcgagaaatcaagatcgtccacatcgcgctcatgctcgatcagatgcacatgctcgggcgactctccgatcacgcccacggcctcgtcatgaccgcgatggccaatataaacgatctcatagccttcccgcacgaaacgcaacacctcgcggtgcactttgctcaccagcgggcagctcgcatcgacgacgctcatgccgagttcgttggcttcgcgcaccacctgcggcgacacgccgtgcgcggagaacacgaccggtatgccggcctgcgccgccgcctggggaatctcggaaagctcgtcgacgaacacggcgccctgctcggcgagttcgtcgacgacatgcctgttgtgcacgatctgccggcgcacatacaccgggggcagatcgtcttcacgcggcgcggcagtgttcaaaatggtctgcacggactgtatcgcgcgatcgacacccgcgcagaacccgcgcggattcgccagaatgattcgtttcgtcatgcctgcctttcgtcgcatcaatcataaccgaatgaatgaacactacacttggttgaatcgctgaataaataggggccacgcgcgctacaatgggcacacgtctcaacaacgaggcaatcaacgacgactggagtcccatgagcgcacttccccctcgcacaggtcagcaattctccatttcacacggcgattacaccgcggtgatcgcgcagcttggcgccacattgcgcgtgttccgataccaaggcgacgacgtgaccgtgtccaccggtcccgacgatgtggtcacctgctgcgtcggccgcgtgctcgtgccgttcccgaaccgtctcgagcacggctcctatgatttcgacggcgcccactaccaactgccgatcaacgaacccgagcgcgacaacgcgatccacggcttcggcatgaactactactggcagctcgaacgactcaccgaagattccgttacgctcagctggcgcgtgccgctcactgaaggatacccgttctcgctgcaggtgttcatcacatacacgctttccaattccggcatgcgcatcgactgcgacgcggtgaacaacggcgacggcccggcaccgtgggcgatggccgtgcatccgtggttctcgaacggcgaggacgcccatggcaacgcgatcgacgccgtcacctcgcgttgcagtgtgcagattcccgcgaacacgcatgtgctcaccaatgggaacctgatcccgaccggaaccgagccggtggacggcacgaaattcgatttccgcacggccgcgttgctcgaccggcagccgtacgacgacgcgctgaccgacctgacccatgccgccgacggcaccgtgaccgcggtgttcacgcggccggacggccggcaggtggcgatcatcggcgacgagagcatcacctcgttccaggtgtgcaccggcaccggcttccccgaggcgatccatccgaccggcgtcgccgtggaaccgcagaccgcgtacgcgaacacgttccgcacaggcatcgacctcatcgagatcgctccgggagacaccgcgcatacgacgattcgctatcaggtgcttcagtgacatacaagccgtccgtcaacacggctacactatgaccattgtgccctgtgcaaagtgtatgcaccctgcaacgtctgggcggcatgcgacaatgcataaggcatatgacggctttagaaaaggagtccactatgggtatgcgcggacgtaagcgtaaggctcgccgtaaaaaggcagcaaatcacggcaaaaggccaaatgcctgagcagctgtgacccgtcttgaacggaaatgggagaggcccgtggaattccacgggcctctcccatttttcgcatatatgaaaccaatgcgcaaccataaccaaaaagccggcatccgggaaacctggataccggcgatgccactcacagtccctgacggtgcgtgtgatggatgatcgtatgcgaggtgaccacggtgtgctcggtgatcacttcgccacagcatttgtccagcgtcatcttcaatcgttcatacaggcattccggcgcctgctggggtctcaaatacgctttcatagcggcgatcatcacctgttcacgcgcgtcgcagcatgatgacggatcgaagcactccccctccacctgcggcgcggatgcatcattcgaattatgcagatcgtccagcgacacaggctcatcatgctcatccaaaggctgcgatatgcccttgctcattgcctcgcctttccgtgagctccaactagttccttctcgcgagcgtcatctcgcgtttcattgctatttgtctcaacggaattcgcctccgttttatttccacgcttcgctttggccgtcgaagtgccacgggaggtcttcgtggatttgccgtaaccgcgggcggcggcgtattcggcgagctccttgcgcagttgcgtgcgtgcacggttaaggcggctcatcaccgtgccgatcttgataccctgttcatcggccacctgctggtacgacttgccatcgatggcggcatcgatgaacacctgacggcgctccggggggagcctgtcgagcgcagccatgatctcctccggcgcgaacgcctccaaatactgctgttcggcggactgtagaccttgcgaagtatgctcggaggccgcgaagatatcccagtcgtcgtattcgccggtggaatcgttcgcacgctgcgggcgacgcttcgccttcgcatactggttgaagaaggcgttgcgttcaatcgtcgtcatccaggcttcgaaattggaacccggcttgaaggtgtcgaaggccttgaagccgcgctcgaacgtgtcttgcaccagatcctgggcatcctccggattgttcgtgaacttcatcgcctgacggtagagcgcattgacggcgggcatggcaagcttctcgaagcgcgcccgcttctcctgcatcgtttcgtgttcattctcgcttgtttcgctcacgccctccattgtacggtacgaggtgaaggaaatctgaaagccagctgggggcgcaaacaccgcgagtgtccgtctggtattcgccgctcgcgcacatgcacggcgcacggtagaattcaagcggaataaaggagaaccatgtctttgtcgttgcaatccgcagcacgcgagctcttcgcggagaatctgctgcatgagatcatcaccccgcacatgtggaccatgaacgcggcctccgtagagaacaacgaggtgccgttcacggcaatcacctacgacacgcgcacggtgacgccaggcagtctgctcgtatgcaaagggaacttcaatccgaaatacctcgagcaggcgaacaagctcggcatggcggcgtacgtggcgacgaacgattattcggcgtacacggacgcgcccgggctcatcgtctccgacgacaagaaagcactcagcattctcgcccaggcatactacgaccacccggagcgtcagctcacactgatcggcatcaccggcaccaagggcaagaccaccaccgcgtactacacgcacgccatcatcaacgcgctgagtggaaacacgacggcattgttctcgtcggtggacaattgcgtggacggcatgcactacgtggaatccgacctcacgacgcccgaatcgctcgacgcggtgcgcatgatgcgcgaggcggtgaacaacggcatgaaatacctggtgatggaggtctcctcacaggcatacaaagtcaaccgcgtctacgatttccatttcgacgtcgccgcgttcctcaacatctcccccgatcacatcagccccatcgagcaccccagtttcgagaactacctgtggtgcaagcggcagatcatacgcaatgccgacatgctcgtgctcggcgagcgcagcgaccacgagcaactgctgctcgaggatgccgaactgaaccgcgtacccgtctccacgttcgcattggccgattcgccggcgcagtccgacatcgcggacgtcacctgcgcaccgaccaatatggagcacacggcattcgactacttcgtggacggcgagcgtctcggcagcctcacgctcgcaatggagggcgacttcaactatgcgaacgcggccgccgctctggcaatcgcgcatgacatcggcatggatgtgagcgacccgcgtgcgctcgcctcactcgccgacgtacgcatctcgggacgcatggaggagatgcacgacagcaggtcgaacacgctcgccattgtcgactacgcgcacaatttcgcctcggtgaacgcgttgctcgatttcgtggagcagcggtacggcgccgagcatccgcatatcacgctgatcaccggttcggccggcaacaaggcatacgaccgtcgcgagggaatcgtcaaagccgcacaggaccgcgtgcagaagctcattctcactgcggaggacaccgacaccgagcccatcgagcaaatctgcagcgagatggccaacaacgtgacgaacgaggatctcgatgtgcagacgatcctcgaccgtgccgaagccgtgaagcatgccgtcgacgaggcgcgtgcggcggacggcggactgagcatcctgctgctcataggcaagggcgacgagcagtggatcaaggaccgcaacatccacacgccatacgagggcgactcgcagatcatccgacgtctgttcgcttgattcgcatgcgacgcgcctacaatgggaacagacgccttggaaaggaacacatgatcatcatcgaacgcgtcactccggccaccatggaggaggaagcgagcaagcacaacattgaactgccaatcgagcagacgtcggtttgggcggatttccaagcggacatcaacggccgtagaccatggggatgtctgctcatacgccgtgacaccgagctcgtcgccgtgatctcgctcatcgacatggagacgcatggataccattacctgcgttccgtgcacggaccggtgtgggcgagcaagccgaacgaagagcttgaggagcagatgatcgccgcgctcgccgactatgtgaagcgcaacgacaagcgcgtggcgttcctgcgcatcgacacatggaccagcaagggcacgttccccgtgctctccaccgtgccgtacaacgaaaccgtcgtgctcgacatcaccggcgacgacgaggagattctcgcgcgcatgaagaaacgcggccgacgcgacgtgcgcaaggcattgcgtgaatcgccggccgtgatcgccgacgagaccgagttggcgacccgtgatttctcggattactacgcggtgatggtggagaccgcgcatcgcgacggcttcaatcccgcgccgatgagcgactacaccgacatgatcaaggcgctcggccctgagcattgccgtgtattcgcgggacgcatcgacggcaaggtcgtggcatggtccatcgtgaccgtgcacggcaagactggcgtgtattactacgcctccatgctcacttcggtgcgtcgcgagcatgtgcctgacaaactgctgtatttcgtggcctgcgcgctcggcaagcagggatgcacgaagctcgatctgatgggcataggcaacgatttcgccccgtcactcaagtcgctcaacgaattcaagacgaagttcgcccccgagaccacgcagatcgccgccgggcgcgacattccgatcaagaaggccttctatcgcatgctgcgcatgatgcaaagcgtgcgcaaggcgttgaaaccgaagccgcacggcaatgcggagaaggtgcgggccaaggaatcggccgcaaagtgatgcaattgtaatacggtatttcggcactttggtcgtttatttcgcacagtgtgaggtaaacgaccaaaatgggaggaactttggtcgtttacctcgcactgcgtgatatgaaccgccaaagtgggacgaactatggtcgtttggtgaacagattacccagtgagtgatcatagttgcccgcagtttgaccctttaccgtgcgccgtgtgaagaaaacgaccaaaccacggcgatatcactcggattcgatatccccggattcgccgtcttccgcaagcttcttcagaccaagcacgtcatcgacgtcgaaatccgggttcgcatcggtttcgtaatcgatttccgcagcgtccgcttcctgcgccttctgccgatattccggatccacggcgacctgatgcacgcgctcggccttcggcttcgtcaaatccgggtgtacgctctccttgagcagcatgcgtgcgtcgcccgcggtgacgaaactgccgcagatgagcacgccatgcccgtagcccacgccgagctcatcgtctgcatccacgcggttcaccgcctcctgaatcgcatccggcagcgacggaatgcaggtgacgcgctccggcccgaacacgccgcgcgcgatctcggcgagcttgtcggcaggcatcacgcggtccgtccacgaattctcggtgacgatgagctcgctgacaatcggttcgagcacgccgagatattcctccacctgcttgtcttccatcatcgcgacgacggcgacgagctgcgtgaaatcgtagttctcttcgatcgccgcgcgcaacgcctcggcggcgttcacattatgaccgccgtcgatgatgatcgtcggtgacgagcgcacctgttcgatacgtcccggaatcttcaccgaactcagcgcttcggccaccagatcgccgtcgagcgcgccgctgaccggaatcaccacctcgcacgcgcacaatgctgcaagcgcgttgtgcgcctgatgctcgccgaacttgtcgaccggcacgtcggcataggtgccgttcggcatacgcagcgtgaccatctgacctcccactgcgggcatgcgcgagacgacctccgcctcatagccgtcgcggatgatcgtcgcatggttttcggccgccgcctgctcgatgatcggcatgacctcgctctcgtgcggctgccgcccgatgatcgccgtgcagcccggcttgatgatgcccaccttctcctgcgcgatctgctcgaccgtgtcgccgagccaggccatgtgatccatgtcgatcggcccgatcaccgccgcatccgcgtcgagcacattcgtcgcgtcccatcgaccgcccatgccgacctcgacaatcgcgacgtcgaccggcgcgtccgcgaacttccagattgccatcgccgtgagcacctcgaagaagctcatgcgcggcgcgccctcctcgtccattttcttgtcgacgagcgcaacgaagtccttcacctgattccacagttccacgaagtcgtcgtcggacaggcgctgcccgtcgatgacgatgcgctcgctcacatgctcgagatgcggcgacgtgtacaggccggtccgcatgccgtatgccctgcagatcgcttcggccatgcgtgccgtggatcccttgccgttcgtgccggtgatgtggatgatgcggaacgagtcctgcggattgccgagcaggtcgaggatcatcctcattcgcttgagatccaggttcgtcgtgttccgctcgctcggacggttcatgatgtctcgctcgacgtcccgcacactcatctgattgtcgctcataagcactcttcccgcgtatgtatacaaacctcgtccattctatgcatttgcccgaccttccaccgccagcgcacgctatagtgtttcccacatggttgagcgcgggacttgggggccgtattgatgacgatgcaggcatgacgacgaagacatcggaggcgacggatcggcacggccgatatacgctcggcattgtggacaacgacccgctggtcgccgaggcgccacgctcctcattcgaacgcttccacgccccgctcgaggtgatctgggcgctcaccgaccccgaagacgctctcgtccactgtctgcatgcgaagggccgccccgacgtcctcctcaccgacatcgacatgccccgcctctccggcctcggcctcttccacgaactccaaacccgcaaactccccattaccgtcatcggcatctccgcgttcccgaacatcgccgaagaacccggtttggtcatcctgcccaaggaatccgccgtcgaggagatcgtccaactcgccggcatgctccgccgtgacgacgacctgacccgctggttcccgaccccaacaaaaccaaacccactctcccccagtgaactccatgccctcacccactactccgaaggtcttacaaccaccgcgatagcccacaccatgcacgtgagcgagtcaagcatgaagaccttcgccaagcgcgcgtatgagaaactcgacgcccattcccgcaccgaagccatcgccatctgcgtaagaaacgggtggatctgacatgaccgaaatactatctgcagactccccaaccaaaccgaaaccgctcaccaaactcgtcgcccacctgcgcgcgcacccattcatcatcgcgggcacattgttctgcgtagcagtgctcgtgtttgaatggctcacatattggccggatctcaacggcttcgagactgccctgagcacactgattcccgtgctcacgcttggtgtcgccatcatgccggttccgttcagtctgtcgatcatcgtcgtcgaagtactgcgtgggatcttctacatcttcccagtcgtccactccggtccgaccgtctattacagcgtctggcttgcgctcatcgtaatcggttacgaaatgcccgcgaaatacgcgattccgatcaccgtgattgccgcgctcgacacgatggtcgacaacgcgatcttccaggtgccgttcgatgcgaacgacatcggtttcgccgccacgttcctgctcgatgggttcgccggcctcgcaatccgccgcaacaaggagttcgcgcgactcagatacgaacagcgtgaacaagccaagcagattcatctcgtccgcacgctgcacgacgacatcggcggctcgctctcctacgcactgctgctatgccggaacgctcaggccgagaccgatccggacacgctgcgcacgtcgctggagacaatcacgcaaaccgtggaatccacgcttgcagatctgcgcaccaatatcatcacgccactttccgcatccacaccggcatccacggcgatatcccgtaacgtggatgagtcgacgaccaccggcagctgcgctcgcctatgccagaacgtgctcaggcagccggcactgctggaacaagcgggattcaacggcacgattcatgtgtctggcgaggcgacagacgaatccgcgaacctcgtgaacatatgccttacggagatctgcaacaacatcctcaagcacggcacccattcgtatgtggtgcgcatcaggttcggcgagcgcaccacacttgtcgcctcgaacgagattgcagcgggtgaggcacagcctgattcggctcatcatggtctggagatgctcgaatccagactccacgacctcggcgcggcgatgaccgtcagcgaggaggatggaatctggactctggcaatcgaacgatgaggaatcagaagttcaattggcatccggagccttccagtgcatgcgtgggttgggtgcgaagtcagtcgacaggtaatcggttgttccgctcagcatctcgttgagtctgccgtcggtgtcgatggcatatacggaatcaaggttctgaatgtccgattcgtagagcttgtatacgaggatcttgcagcgattgcgcccatcctccggcactgcaatcaccgtggcgaagccgccggtccctttggtcagaagggtcctcgagagtgggtagctgtcattgcccagtgaatcgggaagatggaagtgctggtggtcgatgtggctcgtggttgtgttcactgtctcgatggctccggattcgaggaacaccgtcagttggtcgcctacggtgagccctgcgtcgttcgcaaccgataccaacgcccattgtgttccgaacgcctcttgccggtccttgacatatcccttgcagtgttcattcgaaatcaggtagtcacgcttctggtcctggaagaacacgccggtgccgttccacacgatgtgctgttggagcataccttccgtctggatgtattccgcgcggccattgctgtgtacgagtgccacatagcccttgtcgacggtctcgaacttcttgctcgacgggttgagcgcaatcgccgcaatcacatcatcaagttctgcagactccggcgagacgatcctcattccgaacgccccggccatgccgtcacgcacgctgcatccgcccacgaccatgcatacgcatatcacggctgcgatcttggcgaatatcctacgcatcgcgctcacctcctgaatgattgatgtacttccattccagcatcagcgagcgcgacactcaatctatcgctgtccccaaaacggtcaatctgcgaacagagttgaccgcacactgtgttcggtagccgacactggcggcctgctgtgcacgacgaacagattcgcgcccgcgactaccatgttgggcaacggatatctcatgcccaaacagtggagaaaagagcagcaatgagcgaagtaatcaccgagcaggacaaggaatacgaggcgcgtgagcaggcggcggcacccggcgacgatcagccaatgaacgaccgtgtgaacaaccgttcgctgcgcccgcgttccgatgcgttcgtggacttcatgagcagcggttgggacaacaacgagcccgagatcgaacgccttgaatccgcctcctacattccggcacgactccaggtgctgagcgaggcgttccccggcgaacgtctggtgattccggcaggccagccgaaggtgcgcaacaatgactgcgactacgcgttccgcccggattccgcgttctcctattacaccggtctcggccaggactacgaggcgggcgcggtgctcgtgctcgacccgaacgaggacggcacgcatacgccgatgctgttcgtggccccgcgtgcagaccactacacacaggacttcttcaaggacccacactacggcgagtactgggtcggcccgcgcgctggattgaaggagctcgaggcgatgaccggcattgaaacacacgacatcgcccagctggacgacatgctcggcaaggacgtcggcactgagaacggcgccgtgcagctgcgcgtgattcgcgagacggatccgcagatcacggccatcgtgaacgagctgcgcgaggggcatggtttcccggatgaggcagacaatacggtgcgcgacgacaagctgcacgaattcgcctccgaagcgcgcatggagaaggatgacttcgaggtgcgcgagattcgccgtgccgtcgacgccaccaagcacggcttcgacaacattctcaagaagctgccgagcgcactgggcaagccacgctccgaacgcattctcgaaggcgcattcaatgcggtttcgcgcgaggaaggcaacgaggtcggctatgacacaatcatcgcctcgggtgcccatgcgccgattctgcattggatccgcaacacgggcaccgtgaacgatggcgagctgctgctcatcgacgccggcgtggaagtcgattcgctgtacaccgccgacatcacgcgcacgttcccgacgaacggcaagttcaccgatttccagaagaagctgtaccaggctgtgctcgactcgcagcaggccgggttcgaagccgcgaagccgggcgcgacctactccgacatccaccatgcctgcatgcgcgtgatcgccgaacggctgcatgactggggcattcttccggtggacgtcgaggagagcctttcgcccgagggacagcagcaccgccgttggctcgcatgcggcgtcgcgcatcatctcggccttgacgtacacgactgcgcgcaggcccgctatgagtcgtaccaaggtgcgaagatcacgccgggcatggtgttcacgatcgaaccgggcctctacttccgcgaggacgatctgatgattccgccggagtaccgcggcatcggcattcgcattgaagacgacgtgctgatgaccgaggatggccccgaatggatctccgccggcatcccgaagcagatcgacgacgtcgaggcctggatggcgcagatggcggacaccaacaactgagccagtcgctcgaaaggagcatcatgccgaccccggatttcattctcgaattgcgcgagcgcatcggccacatgccactgtggctcatcggcgtcaccggctatgtgcgccgcgacgacgggcttgtcttgctcgaacagcgcaccgacaacggcaaatggacgctcgtcaccggcatcaacgagccgggtgaggagcctgcggacaccgtcgcacgcgaggcgaaggaggagacgggcgtcgatgtgatcgtcaccgatctggtgagcgtgaaatccgaccggcgcatgatcacctacgccaacggcgaccaggcgcagtacatggatcacctgttcctgtgcgaagtcgcgccgggcggcaacggcgaaccggtcgtcggcgatgacgaaagcatgcgcgtcgggtggttcgcgctcgacgatctgcccgaaccgctcagcgacagcacacgcgaacgcatcgcatacgtgcagcggtatctcaggcaccgtgcggaaggaagcgcacgggcacagttcgcgttcgacggggtcatcgagcatctgtaggccgcatacagcggcatatgaatcaatggatgctgccgaactccaccgggcacctgtccgagtaatggtttggcagaaaatagcacacggcacccgaatcgggattggcatcgcgcatgtcactcaattcgggtgccgtgtttttgggcgtgtcgcatgtattaactgcgttaatatataaacatcgttaacacatgagttcgcggctgcccagcggccgtacacaacgaagtgaacgccgaaggaggtgccatgaactcgcggaccaccaccgaacagcagaccctgagcgaatacaatcgggcccgcacactgcagtatctgcaccaccatggcatcgcctcacgcgcacagatcgccaaggcactgcacctcacaccggcggcactgagcaagatcagcaaccatctgctcgccagcggcgcaatcgtggagaccggtgccctcgaaggcaaaggcaaccgcaggtcaatcggactggcggtcaatgcccgggcgttccaggtgctcggcgtcaaattcgcgcgcagtctcatcgagatcggtctgttcgacctcgccggcaagccatcgttcatacgagaactacccaccgtggagaacacgacgattccgcaggccatcgaaagcctgcatgccgaaatcagacgcctgctcgccgagcacccgcacatcctggccatcggcatggccgtgccgggcccctacctgcgcgatcgcgggcacactgcggtcgtctcatccatgggacaatggcgacaggtcaacttccgcgccgaattcgaacatgccttcgacgtgccggtgatcatagaacaggacgcccgcgccggcgcactcgcccagtatctcttcgacccgaatccggcgaatgagaatctggcatactatctgctcggcgaaggcataggcctgggcgtcatcgaccacggcaccgtgatcaacggctcgctcggcgcggccacggagatcggccatgtgagcatagacgtgaacggcaaggcatgcgattgcggcaatgtcggctgtctcgaacgctactgctcggcggtcgccatacacgaggcgatgctcggcaacggcatgctcgccacagattcccggctcacccatcgcgaggcatgcgccgagctgttcgcacgggcgcaatccggcgacgggcaggcacgtgagctggtcgagcggatcggcacgttcgtcggctatggctgcgtgaccatctgcaacgcgttcaatccatctcgcatcgtgatcggcgacatcgtggcgcaagccggcgaaccgctgctccagcgcgtgcgcgaggtggtcggcgagcgcgtgatccccgaaattacgcagtccacgcagatcgagctttcggcactgcccaccgatgcggcggtgaccggcgccgcagctgtggcgattacgtacattctcgaccatccatcgcaattctttgccagcggtacgtagaattgaattaatccgttcacaagcaacacaaccaaacaacaacacacaagaaaggtgacatcatgtcaaagccaatcgtggtctccctcggcgaactcctgtgggacatgctccccaccggcaagcgtgccggcggcgccccggtgaacttcgcctaccacgccacgaacaacggctgcgaagcctatgcggtcagcgccgtcggcgaggatgagctcggcgatgaactcgccatcgccgcggagaaggccggcatccatgccgtgctgcagcgcaacgcatggcccaccggcaccgtcgaggtggccctgaagaacggcatcccggagtacacgatcgtcgagaacgtcgcctgggatcacatctcctacacccgccagctcatcgacatcgtcgagcaggccgacgccgtgtgcttcggcacgctggcacagcgctcccccgagtcgcacgacacgatcatcgagctgctcaagcacaccaaggacggcgcgctcaagttcttcgacatcaacctgcgtggcgacatgtattcgaaggagctcatcgaggagatgctcagctatgcgaacgtcttcaagatcaacgacgaggaactgctgctgatgcgcggcatgttcggcatcgagaacacctccgacgaagaggcctgcaagtggttcatcgagcagttcgacctgcgctacctcattctcaccggcggcgccaccttctccacgatcatgtcgaacgacggcgaggtctccacgctggcaaccccgcacgtcaccgtggccgacaccgttggcgccggcgactcgttctccggcaccttcaccggccgcattctcaacggcgactccctcggcctcgcacaccgcgcagccgtgaacaccgccgcattcgtgtgcacgcaggaaggcgcatggccgacctacccggccgagatcaccgactacctcgccgagatcggcaagtgagcgtgacgcttttccgacaatgaaccggagtctgcagactgctgcgactccggttttcttacgccccgccgcgctatagtgccggtatgagaatcgtattgcagaaagtgagccacgccggcgtgaccgtgaccgacgaggcaatcggcgaactcgacacgacattcaccgaacagaccatcgcagccggctatgtgctgctcgtcggcgtgagcgatgccgacggcaccaggcagatcgactggctcgcccacaaaatctcgaatctgcgcgtgttcgaagacgaacagggcaagatgaatctgtctatccacgacgtcggcggctcgattctgtctatctcgcagttcacattgttcgcggacaccagaaaaggcaatcgtccgagcttcgtgcgcgccggcaaacccgagcatgccgaacgggtctggctcgaattcaacgaggcgttgcgcgcgcagggacttcaggtgaaggagggcagattcggcgcacatatgaatgtgtcgctggtcaatgatggcccggtgacgatcctgttcgacacggaggagcttggcatataacgccacaatcaatgatggcgagagcataagccctcgccatcattcccgtacttcacccggaacgttgttccaagtcgcggatacccatagtctacaccgcgccgcggtacatagccggtcacatacgaaaaacccactatttccagtgggttttatgctatttgtggagccgcgggggattgaaccccaacatatcatcctagaaaacgttgaaataacgccattctcaagcatcacatctgtgttttggacacgttttggacgcatttagcctaggcggccgggaagatgctgtccatctccacgcgcaccacgtccaagtcggcgtcgaacaggtcggcgtaagtatccaacgtcatggcggcgctttcatgccccaactgcctttgcacgaccttgacgttcgcgcccgcgctcacgagcagggacgcggccgtgtgccgcaggtcatgcacggtcatcttcctcgccaacacatcacccagcgcacgtttcttcgcccaatagaaccacgagcttggagagttcggcccatgagtgcgcctgagcatcttcccttgctgatcgacaaacaggggttcgtcgccgtcacgtccttgcgccatctcgacgagcatcggctccaatatggccgggtaggtgatcgtccgtttctcgtatgttttcggcgtgcctatcacaacctcccctttgacctcgacggcgttgcgttcgatcctgagccggtgtcctttggcatcgaggtcacgcacccgcaagccgacgagttcaccccagcgcattccagtcgtgcccaaggcgagcacggccggccgacgccacccggcctcgtcggccaaagccatgagctgctcggccgtgaggtatacatggtctttcctcttcttgcggggcactgtgatgtcgtcggcggggttcgacgcgatcagccggttcttcaccgcggccttcaacagacccttgagcatatcgcgtgcgcgtatcaccacggacgcgctgtattccccagccaacttgttcacccattcctgcacttcgtcgtggcgtatcgacccgaccttgcgcgcaccccattgcggccccacatgcttattccacgcgccccccaatgattccatgtagcttggtttgcatcgtgtgcgcttcgtctctatccacgactgccacagttccgccactggagtgttccccgcgctttgcgtgatgaacgtgcccttggccttggcgatctccacgttctcagcggcccatgcttccgcgtccatcttgcgcaggaacccgcgtttgcgcgtcgtccgtccgcccggtgtccggtagcgcacctcccacttgacacactttttcgtctcgtacttccccactgtgtagctcatgctttcatctcaaccccaccatgagacagtgcgcgcatagggaaagcggcgcatggtaaggaggcagaccatgcgccgcttcacatatgggtgagccccgatcattgggcgcatgaccggggcttccctgttggcggcgcgggccgttggcgtccattgattatgaggttcgcgtcgcctgttgccggtgtcaaccccccaccggcaagtctctactcgttgtccgggatcggctcgttcaacgccttgatttccgcagcacgcagcctgtccttttcggccggagtgtacgcggtgtacaggccctctgcacgggcctttgcggcccatttcgccacagcgggtttcgacacgccgaaccccccggcaagcacttcacgcgggttcttcatgatcttcgttgcgacggaatagagccgcgcgaatgctttcagatcaagggaaccggactcttccctagcctgtgccacatagtgcagatcgttccagaaattgtagggcatgtaatcgaagtcactgattggagtgcccggcctgtacctcagaagaacaaggctcaccgcgtagttcttgcaatcttcgatacgcaatgcccgcaggagatttgcgttgatgatccaagttcgggcggggtctgtgctgtacaggcgcattccaatcacgtcgtattcgtcccgtgggaagcctgagtagttgatatcaagggccagcatgaggccttctttgccttccaccggaatatcagtgacggaaaaacgcgctggagcgtcaacgtcctctgcgatatccacaacagtactcatgttcagggagcggtcatagatcttcactcggcggtctaagagcggtgcaatttcacgtgtttccatatgcacagcgtatcaccgacacgcccgataggttcttataggacttataggaatacaatgaatggaaaacgtgtagtcctatacgacgcacaaggatacataaggacaggatatggccacagacacaccgaaaacgaccacaagggaactgctcgacatcaagcaggtagccgaacgaatcggcatgagcgccacaaccatctaccacaagcgccgcacccacaaggacgaagtgccgcccgcgatccgcatcggccgcaaactcttctggcgacccaaagacgtcgaccagtggatcgacaaccgcccgaccgtgtgaaacaaggagccaccatgcaacgcacaccactgctcacaccggacgaagccgccacctacctccatgtcagccgcctcaccctagcccaatggcgcgccgaaagaaccgggccgcgatacataaaactcggcacgctacgacccggcagcgtcaaggacacacgcgccgtacgctaccggcaatccgacctcgacgcatacaccgaacaaaacacgtacaacaactgaaagaagcaccccatgaccgaacagcagatcaccgacaaccggcacgcgctcgtggaaagcctgccaccacaattcacccgcgaacaactcgccgccgccaccaacaccaccacaaccctatgggccctcaaagaggatcgccacgccggccccaaatgcacccacaccgtcaacggccagacatggtacgcacgcgacgacttcgccgcatggctctaccggcagcccgccacaccggacggcaggtgacggcatgaacaccacacaggaagcgctcaaagaactgcacagggacatcgcacgcatgttcgacacactgatcgcgcacgtaggcgacgacaccgccgcatggcaccaagccgccctgctcagcatgatcgacggccgcatcgtggccatactcgccaccaccaccagcaaggaggaaaaccgatgggatcgatgatctccgactcgttggcacgctcaccgctcgtgcggttcacacccgacgaactcgcctacgtgggcgacgggatcccacgcaccgcaggcggcaaacccctgccttgggtatgggacttcctcaccgacacacaacgcgcacaactcgaagaagaacagaaagcacacaaatgggagtagaggtagcggcaaacccgcaacaacaagccatcgcggacgccctatgggacaacgtagagaaacaggcgcgcgcacagcatgacggccgtaggatcgcgctcacacgcgcctgcgacgtgaaagtggaacgcccagtgttcctgcacaacccgctcgtacccacgaaagtactcacgctgatcgccggacgtgcgggcgtatcgaagagcacgctgagcatcgacatagccgccaaggccacacttggcaagctcacgggcgactggcaacaccagcccgtcaccgtcgcgttcgccgccatcgaggacgacatgggaatgcagaaagcacgcctacaggccgcaggcgccgacatgaaccgcgtcttgttcctcaccgtggacgacacaagggacggcaacacggtaagcaccggcctgcaactgcccgacgacaccgccaccttgcgtgacacactccgcgaacacgacgtgaagctcttggtcatcgacccgatcacctcgtgcatcgacggcaacaccgacaagcgcgacgacgtgcgccgcagcctcgacccgttggccgcaaccgcccaagaactcggtatcgccatcatcggcatactgcacttcaacaagggcggcggctacgcctccgacaaggtgagcggctcgcacgccttccgtgacaccgtgcgctcgctgatcctcgtggccaaggacgacgagacgggcgaatgtgtggtgacgctcgataaaagctcgtacacgccgcaacagggcgcgtcctacaagtacacgctcgccccgcgcttcatcaccgacgacgacggggaacgcatggaagtacccatcatcgccgggttcacgccgaccgacacgaacgtgaacgaggtcatcaaccgcaatgtcaccggaggcgacaccacaggccgcgcagcagacaacgaagtggccgactggctcacagcctacctagccgagaacgggccgacgaactgcaagcagatcgccgcagacgcgaaggacgccgaaggatacaccttcaaacagctccagcacgcccgcgaacgcctgacctccccgcgcgtcatcgcacgcaaagaccccacatacaccggacgtggacgccgctcgctatgggaactcgaacaacccgaatgcacaagcacgtattacgccccatcaacacatggggtgaaatatggggcctaatcctaaagccttatattgcaagggtttattaatacgccccattacaccccatctagaacacgagacatggggcgtaatgattacaccccatcacaccgtgtctgagatggggcgtaatggggcgtaatcaaaaccgttggaaacactagcgtttgaatacaccccatattacgccccatcacccatatggggcgtaaaaacagccacccacaccaaccaccacacaaggagcgacacatgaaccaacaaccacacgccgacatcgactacgatccgaacgccgacacgatcctcagcgcccacgactgggcaatcaacaccgacatgaccgtaaccgaatacgccaccaacatccaagcattcagaaacgaaacactacaggactgggaagcaaccacaccagacgaactacgccacatggcagaccacatacgccacgactacgccgacaccctcgacgccatagccaaccaatgggaacaacacaaccaaggagacaccacaccatgaacgacatctaccagctacccgcgctcaaccgcaccatagacgccctgcacctagacgacgaccggcacgccgcgcagatcacagccgcacgcctcatagccgaacaactcgactacagcgacaagcccacggccaccctatgcgccgcctacgtgcgactactccacgacctcaccacacaatgaccgccaccacaaggagcaccccatgggcaaacctcaagagcaacccgacatgatccacaccggcgacacccactacgaacaggcacgcgcacaccggatcgcacacgacctgctcaccgcagccgcccaagcactcatgcacggcacaccaccacactacccacggctcaaccgcgccgacccatactcggacgcagtcaccgcaaccatactccaccaactcgcaaccacaacaacaaccaccaaggaggaacaatgaaccccatcatctacgccgacatgcacgaacaccggctcggcctctcattcatcgccgcccagtacgacgacaccggcatcgaagccatgctcgaccaaagcaacaccatcgacttcacctcacccgacgaactcgacgctctggccgactacgcacgccacgaactcgcggactggctcgaagaatgcgcacgccaataccgcaacgccacccaaccaaccgacaacaccgacacggaggatacgaccatgcaccgcaacccaacacacccatacaccggcacaccacaacctaaccgaaccaccatggggtaacgaatcgttaccccatcatcagcaagggcatcgtgaaacgcgaccaccttgccgacaagggtagggggagtccaaaaaataaaacaatagacgcgaaacacccgccgccgaaactctttttttcgcgtctcaaaaagatcgggccttttcggacgtgacggcgcgtgccacacggtaacgcgccgtcatctcccaccgttgtcccgcttgccacgtgcttgttcggcgggtaggcttggcattgttcggtgaagccgatccgggccgctgtacagtcgccgcgggttcgcaagagaccggactgtttgccagccgaggccgctgcacgcagtcgccacaggcacgcggatagagataaccacatattgattgttaccacgctttccggtgtggcttagcaaaggtgtatccgcatatgtattacaaaaccaatgattcacacatctatgtgaagtccgattccttgggtgatgggcttgaggagggggatttcaaggcttacgtgagcacttggacgcgcacgcccgactgttacggcgacgtggttgccaagggcgcgttctcgcagacgttgcgcaagtgggatatgtcggggtcgtgcattccagtgctgtacgggcataacgagactgacccggactacaacatcggctatgtgaagtcggccatcgaggacgaccacgggctgcttgttacgggccacttggacatcgacacgaacgcgaaggccgctcaggtgtaccggctgctcaaaggccataggctcagccaaatgagtttcgggtacacgatcgaacgcaaggcgcaggctcagagcgccaagggcatggccaacgaattgcaggccgtgaacctgctggaagtgtccatcgtgccccacggcgcgaacaaggacaccagcatcgaggccgtgaaatcggagtccgcctacccctccaacttggagccattattcaagaccatcgacaccaccatcaaatacgcaaagaatggatatgagaacatgagcacgaaacaggatcttttggacgccaagggcaagctctcgcagattgccaacaactctgttggacgcatgttgtccgacgctgagcttgaggaggtgacccaccttaagggggtcgtggccgattgcgtcgaaaagctcaggcgtgacggggacatcaccggagatgttgaccagtggcttcacgacatcacaagcccgaagcgcgtctccccgtatagcaccaagagctacctcgacctctccaagctcaccaagagcattcccgaaaccatgcgcaaggacatcaacgaacgccatgtcaagggcatcgacatggcgtcgatcaccggggccatgttcacgcccacgccgatcgtcaactccattccgatccacgatcagggcggcgagatgcccatcggcatcgtcaactacattcctgccggagtggtgcatacagacgaatatgactatctcatggaaaccacgcaggaggacgcgggaaccgcagcggtcgtggagaagggcgagacgaagccaacgttcaagctcggcctcaagaaggtacgcaaccagctcaaggtgatcgccgtcgtgtccgaccctgtggacaagtacacatggcagtcgtctcagggcgtcgtggattatgtgggcgaacgcctcacccgtgagatcatgcgcacgttcgagaacgagatcatcaacggcgacggcactgcgggccacctgctcggcctgaaccatgtcgagggcatcaagtcgcaggcgttcagctcggacgccgtgaccaccgccatcaacgcggccgcgcagatcgaacagtacggcatcacctgcgccatgttcgtgcttcccgcagtggactgggtggagatcgccaccaccaaggacacgctcggccattacatcaacgatccgatcgtggacgtgcagaacaagcaattgtggggtgtgccggtggttgccgacgcctatcttgagtccggcaccgggtatgcgatcggcacgaacaccgtgcagatcatgacggacggcaaccttgagacggcgacgaacacgagcgagggtttccggacgaacaccgtcatctcccgtgtcgagggccgtttcagcttcgatgtgctcaagccgcacggtatcgtgaagttcgccaccaaggccgcagcgaagtccacgccgacgaagtgagggggcacgccatgagcgacagggagccacggtacaggaacacgcaggtgcttgagggcaatgcgggggcggattacacgcaacccgcctatgcgcggtacgctacccgcgtgaaacccgatgcaggcccttatgatccggtgaacagggacgacccggagcgtacgatcataatccgggatcgtgtgctactgaccggcgactacctgaacccaatcgtggacaacctgtagcggtgtgcagggcatgtggggcggttgtgggcttgagcgcctgcaccgcccctgtgctttttggcctcattttggacacgtttcatattggaatgcgtccattttaacccatttacacctatatccacggggcccgaaaacccttggaaataaacgaaaacccgccatttctggcgggttctgaaaaagtggagccgcgggggattgaaccccggtccggtgaccgtaccctcgtccttctacatgcttagtctgctgactcgaacgagcgtattttcggcccccgccaatgccgcagacaactggcggcgagcctagccacagcaaaatgtccttgcgagaccctgcagttcaatctcacaagtcagtctcctaacgacacctgacctctccccgaagacgcgggagagcagatggagtgctaactcgctggattaaatctgattacgtttaaaatcaggcagcgagagcgaactcagtgcgattagatttagcacttatttttattgcagagaacatcacgagtggaccctgcattctcggcatgcttctccaaggcgaacagatcaccgtcgaaaccaatcggccccttttgaattatcaaactcaccggcgtagctctcgcctagccggactttccaatatagcacaacacgaacgcactcgcaatattccgatgtatgcgtatggggcgcccgctcccacacatgcgaagcgggcgccccattatttgcagattccctaggcctcctcggcgagcagcttgcgcagctcctcgcgatgtgcggcctgctcgcggggatccggaacaggcagcgacgccagcagcttacgcgtatacggatcgctcgggtgttgcatgatctgcgaggcgtcgccgtgctcgacaatacggcccttgtgcatcaccatgatgcggtcggcaagcatgtccaccacggcaagatcgtgcgtgatgaacaggcacgcgaagccgatctccgcctgcagcgtcttgaacagctcgagcaccttcgcctgcaccgacacatcgagcgccgaagtcggctcgtcggcaatgagcagactcggtttgagcgcaagcgcacgggccagcgacgcacgctggcgctggccgccggagagctcgtgcgggaagcggttcatatatgcacgcggcagctgcaccatctcgagcagctcccccacatactgtttcgcctgcgagaccgtcttgtaccggccgtgcacaatgagcggctcggccacattctcgagaatcgtcatgagcgggtcaaaggagctgcccgggtcctggaacacgaagccgatctgctcgcgtagcggcttgaacttgcgttccttgaaatcacgcatctccatgcccagcacattgagcgaaccagcggaaatgcgctgcaagccggcgatggcgcggcctgtggtcgatttgcccgaaccggactcgcccaccaatcccagcacctcggatttgtgaatttcgaagctcacatcgtccactgccttgaaatccggctgcatctgccccggataggtgatgtccatatgctcggccttgaccaccaccggttcctcacgccaatcgacactgcgctcgatcacatgcccggcggcatcgcgcaccatgagctgctgtccgatgcgtggcacggctgccagcaggcgcttcgtgtaatcggcctgcggattgtagaagatctgttccacgctcccatgctcgaccacatggccgcgatacatgacgaccacctgatcggcgaggtcggccacgacgcccatgttgtgcgtgatgatgagcaccgaggcaccgaattcgtcgcgggcgagacgcagcagatcgaggatctcggcctgcaccgtcacgtcgagtgccgtcgtcggctcatcggcgagaatgagtccgggattgagcacgagggccatcgcgatgacgatgcgctgcttctggccgcccgagaactgatgcggatagtagtcgatgcgcgtggcggcgtccggaatgccaaccttctcgagaatctcgattgatttcgcccgcaattgcttcttgtcggtcaaaccgtgcgcgcgcagaccctcctcgatctgccggccgatcgtatagaccgggttgagcaccgagttcggctcctggagcaccatggccgcagcgccaccgcgcacctgctgcaggtccttgccgctcatggtgagcacatcgaagccctcggccccatcctgtgcggtgcgaatgtagatcgcaccgccagtggtggccgtctcgggcagcagcttgatgatcgagcgggcggtcaccgatttgccggagccggattcgccgaccacgcccaccacggtcttgcggggaatggtgaaatcgacaccgtcgattgccttgatcgggcccgcgtccgtcacgaacgagacgctcagacccttgatgtcgaccagattgtctcccatcgacccagtgcgttccaactcatcgctcattgtcgatcactccctcgctctcatccggcacgtctttgttcaccacggccgtctccggatcctgcgtcacgaggtattcgttcacgtcctcacccagatcggcaggcttctcggtggcatctttgatggccgcgtactcctgttccacaacggcctgtgagataggcccagagtcaggcgaatccaccgaggtgtcttcgattgaaccgaccacttcgccggcggacttgcgcgcacgcagtcgcggatctgccaagtcgttgagcgactcgccgatcagcgtgatgccgagcacaatgagcacgatggccagaccggggaacacggcggtccaccaaatgccggaggtcacatcggcaacggaacggttgaggtcgtagccccattccgcggctgccgtcggttcgatgccgaagccaagaaagcccaggccggcaagcgtgagaatcgcctccgacgagttgagggtgaggatcaccggcaacgtacgcgtggagttcttgagcaggtgcttgctcatgatgcgccaggtggaggcgcccacgaccttggcggattcaatgtacgcggaatccttgatgcgaatcacctcggcacggatcgtgcggaagtactgcggaatgtacacgacggtgatcgagatgccggatgcgagaatgccgccccacagactcgactgaccgcccgagatcataatggccatgagaatcgccagcagcagcgacgggaacgagtagacggcgtcggcgatcacaacgaacacgcgatccacccatccgccgaaatacccggagacaagccccaggaacacgcccgcgaaaatggagagcagcacagccaccacaatggcgatgacggcggtgcgcgcgccccataccgtgcggctgaacacgtcgaatccacccaccgtggtgccccagatatgctcgcgtgacggcgcggcctgcgtcgggaacgcaacaccgtcgtcacccttgatctgcgcatatccatatggcgcgatccacggcgcgaacaccgccacgagcaggaagaaccccgtcagcaccagaccggtgacaagcatgcccttctgccaaccgacggcaattttcagatcgcgcaccacaggcagtttcgcgaaccatgactgcggcttctctatgttgggattctccagacgcgcgtcacccggcacgccgactctggtttccgtgctttcactcatttcagtaccgcactcgcggatcgatcaacgcgctgatcacgtcgacgatgaagttgaccacggagacgatgatcgcaatcaggatcacaatgccctgcaccgccacgaaatcacgtgccttcaaataattggagagcatgaatcccaagcccttccattcgaacgtggtctcggtgagcaccgcgcccgcgagcagcaatgcgatctgcatgcccatcaccgtgatgatcgggatcagcgccgggcgccaggcgtgcttcgacatcaggcgcttctcggaaacgccgcgggaacgggcggcctcgatgtagccggcattgtaggtggagatcacattcgtgcgcaccagtcgaatgaacacgcccgccgtgagcaatcccaaggccagcgccggcagaatcgcatgcatgagcacgtcgccgagcaccttcatgtcgccgggttgcaatgcgtcgacaatatacagcccggtgggtgagaccaatctggagaactgcatctccgattgcagcgaggagcgtccggagctcggaagaacaccgagtcccaccgagaagatgagtttgagcaccaaaccgaggaagaacaccggcgtcgcatagcacagaatggcgaacatgcgaatgccggcatcctgcgcacgatcgcggtgcttggcggcgatgcgtccgaagccgatgccgacgagcaatgccacgacgagcgagagcaacgccagttcgagcgtggcggcgccataccgtgtgagcaccgagatcaccggctggttgtcggtgagggtacggccgaggtcgccatgcagcaagccgcccaggtaatcaaagtactgcacgatgagcgggcggtcatagccggccccgtgaatgcggcgctgcagttcctcgggtgtgagtctgccgcccatcggggccgagatcggatcgccggtggcacgcatcacgaagaacacgatcgtgacgagaatgaacacggtggggataatgagcaggaagcgaccgagaatgaagcggaagaatcctgcggaaagtctgtttttatgcgcggttggtttcgatggtgcggaatccgccggcgatgctattgcttgagacaccggatctccttggaataatgcgggaatgaactggacaacgggccgggaacagtcaatgcctggtgcgtcccggaaagaacgcaccaggctgacctatgcgaaggacctcagttcttcaccacggaggcgtagcggaaacggaacgaggggtcgagcacgacaccggagacgttgctgccggtgaccgccacctggttgccctgcagcatggggagcgtggagaggtcgtcggtctcggtcttctgaatgtccttgagcatgccctcgcgcttggcttcgtccttctcgccggcctgcgccacaatggcgtcgttgaccttcttgttggagtagccgttgttcacgaagttgccgtcgcggaagaacggggaaaggtaattgtcggggtcggagtagtccgggaaccagccgagctggtacaccgggtagctaccgtcggagtcgtcggtgaccacacgctccttgttgtactgcgtccattcggtctgctgcaggtcgaccttgaacaggccgtcggcctcgagctggctcttgatggcggcgtattcgtcggccgagctggaaccgtaatggtcgccgttgtactggagcttgagatccaccggggtggccacgccggcgtccgagagcgtcttcttggccttggcggcgtccggcttgccgttgtccgtgtaggccttgagcgtgttcatggccggtcagaccatcgggaatgaaggaatagagcggggtgtaggtgcccttgtacaccttctgcgagagctcgtcgcggtcgatgaggctggcgacggcctggcgcacggccttggccttggcggcgtcggcgtccttctgcgattcgccgtacggctggagcttgaagttgaaggcgagcatgcgcacctcaccgcccgggcccttgacgaccttcaccttgctgttcttgccaaggtcctcgatgtgggtgggcgaaagcgagcggtaggccacatcgacctgcccctgctccacggccatcttcagattggaggcatcggcgaagtacttcacctgcacaccggagttcttcaccggcgtcagcccctggtagttgccgttcttcgaatagctcacggcctcgttgagcttgaacgagtcgatctgataggggccggcgaatgccttgccgctcacgatcgtgtcggcatcggtgattttgtctgccgagaacacctcgtcgtcgacgatggggcctgccggcgagctcatgacctgcttgagcgtgacgtcgaacggcaccttcgaattgaacacgacggtgttggcgtccggggtttcaatcgaatcgatgttggcgagcagcgagctcggtccgttcgggtcgttgatcgtgtcgatgcggtcatacgagaacttcacgtccttcgagtcgagcgtgtgaccgttcgcgaacttgaggccgtccttgatcttgacggtgaactgcttgccgtccttgctccacgtgccgtcgtcggctgcgatgtccggcgaaagctcggaggtgttgtaatcctgtgcgtacaggaaggggaacacctgaatctgcacggcataggaaccgttgtcgtacgaaccggccgggtcgagcgatgtcaccttgtcggtggtgccgacaagcacactgttctcacccgcggcattggcggcgtcgtccttcacgccgccgcaggcgctcaccgagggcgagcgcggccaccgatgcaatggcggcgatgatcttctttgcgttcacaccgaaccctctctcttctggaattgctccactctctcacggaacaattaccaagcagattgtcagcttcacgcattacctgcacgtttcgcctcagcatacgtatgcgcatgaataggtatgctggaggcaaaagcattgcaatacagcgcttttttgatttccggggtgtttccgggcagtttcgtatgctgagatttgcccggggccacactttcccccggcttcgttatttgatgatcggccttcccggcgcggagacgttgatctgtttcttgtcgccgatcacattcgggtcgttcatgatcttgtcgacaatcgccatcttgagtttcagttccgcgctgtcgccccacacgatggtgatgccgttgtcgagtgtggtcgtcaccgagtcctgcgtgttcgcgctcaccgcggtcactcgggtgcgccaggattccggcatcgcgtcgagaatcgtcacggcggcgcgcaccgatcgctggccgagtgcgtcgtcgatgttcttcacctcgatcaccggaatgcccttgactgcctgattggtcacggaattgagcacacgcgtctggttatcgaccgccgtcagaccgtccttgcctgcaactttgagcattgccgccggtcgttgcgcggtcacctccacctcgagtccgttcgggaatttcttcgtggcgcgggacgaggagacgcccgggatgtcatcgagctgttgttccaccgacttgtcggagacgatgagcagcgatttgccggcctgctgtttggctatgtcgaggatctgcgtgcggttcacccactcattcgcgcccatcaccgtgatcctgtcttgccgcaatctcagcgccggcgagaagaacagcagccagatcaacgcgatgaccagcgcgaagacgaccgcgccaatgcctatacgcatggcgagcacgcgcagattcgcggttttacgttctcgttggcgctccttgaaatccacgacttttggccgggtggcgacgccgatcgtaccggcggactcatcgagcgtgcgcgcgaccagatcctcgctttccagcgcccgtgcatcgacgaacgaaccgggcgcggagacggcctttgactgcgaggactgtgcggtgcgcgccgtgcgttccgattcgcgcctgcgtttgcgcacgagtttgcggaagcggtaccgtgggcgtttggccgaatcattcggaccagatgacacctgcgtggattccccgctggcagattgccgttcggcatcgtgggttccggacgtggctgtacggggctcaacggttcgtgactggccgccacgcacacgtctttccttgccggcgcgcaccgatcgcgcggcttttgccgaacggccggaacgtgcctgcctgcctcgcatcgccttcgggtactcttcgaacgactgcgattgggtgggcggctgctcatcgtcccgcacggctgcggtattgtctcgggtgggcgattccggcatatcacggcgcgagcggacggctcggttccccgacccagcggacctgaccgaccggccgcgcggccactgcggttcctgccgctgcgagtccggggaatgaccggaggagctcaccgtacgtcttgccatatcgccttcctatgccgtgttcttcagccgctcagtcctgctgggcgttaccgtaatgcgcttcgagcacatgcaggatcaccggccccatcctcgtgatgtcaccggcgcccactgtgaagatcacatctcccggctgcgcgcgcatagcgagcatctgggcggcgagactcatatcgtccaccgcctcgatctcatacgaaccgtcaccatgcgcattgtccacaatcgtgttcggagtcacctgcgggaaatcagactgcttctcacgcgccgggaatatgccggtcacaatcacatcgtccgccagtgagagcgcatcggcgaactcctgtgcgaagaactgtgtgcgtgagaagagatgcggttggaacagcacgtgcagctgcgaatcggggtagcgtctgcgcgcggccttgagcagcgccgtgatctcggtcggatggtgtgcgtaatcgtccaccacggtgatgtcgctcaccgtgccgcgaatctggaatcggcggttcgcaccgaggaaggtgccagccgcgaccgccgcgcgttcggcatccatacccagcagaacggcggcaagaatggctgccgtggcgttgcgggcgttgtgcaggccggggatcctcaagctcaccggcaatgcgacgtcggcaccgacaagcgcggcgggaatgtcgatcacgaagttctcggtgccgctgttcgcggactcgtgttcggaggcgatgtgcacgaaggtggcgccgttgaggtcgccgagctcgtcggcggtgtgggtggaataggcgatcaccttgcgtgcgtcctctggggcgagcgagcggagcacggcaagcgccccggcatcgtcgacgcacatgatcaccgcgcggcgggcatgcgtaacgtggtcggcgaatgccgcgtgatagttctcctccgtgtggtagtggtcgagatggtcggcctcggcattcgtgataatctcgatgtcggggtggtatttggcaaagctgccgtcagattcatcggcttcggcgacgagcaccgtccccttgccggcatgtcccccatcgagcgtggttccgtcgggtccctgaatggagccgccgatcgcatagctcgggtcggcgagttcgccggtgccggcatgcatgagtatgtgggcgagcagcgagctcgtggtcgtcttgccatgggcgccggcgacggtcacagcgtgcttgccgttcatgagcagggcgagaatgtcactgcgatgcaccaattgggcgccattggccacggctgcgacgatctcaggattgtccggcttgatcgcgctggaatacaccaccacctgcgcatcctgcacgttctcggcgcgttgggtgaattgcaccggtatgccgagtgattccaaccgctcggttttcgcgcccggttcgcggtccgaaccgtcgaccggcactccctgctcatgcagcatctcggcgagcacgctcataccggcaccacctatgccaatgaaatgcgtgttgcccagatctgcggcacgcaggtcttcgccgaactgtgccacggtcggatcaagcacaatggattccttcaccttcaagctccttgctctgtgttccgctgtcccatgcagcatggcttcagactcgcgcatcggcgatggaaaggatctcacgggccatacggtccgccgcatcacgaatgccatactgccacgcatgctcaccatatgagcgcaagcgggccggattcgccagcaatccgggcacttgcgcggacacccactgcgaggtgaacgatctgtcgtccacaatgatgccgccacctgcgtcgctcaccggaagcgcattgaaccgttgctcgccgttgccaatgggaagcggcacatacaccgccggcaacccgagcgccgtcagctcgctcaccgtaccggcaccggacctgcagatcaccaggtcggcacaggcgaacgccttgtctatgcgctccaagtactgcgcgacgtggtagttgcgcccgggccggctttcctcacccagaccggtgagcacatcggctccggcgttctgcaccaccagatcacgcacctcgtcgatcttgccttttcctgtcagatgcacgatttgcgccacttcggtgagctgcctggcactgccggcaacggcgcggttgatgctctgcgcgcccagcgaaccgccggtgaccacgataatcggccgattcgggtcaagaccgagttcggcggcattgcgggttcgggcgccttccctgtcgcgttccagttcctcggcgagattcgctatggcaggtcgcaatggcagtcccacacgctcgattccgccatcctttgcgggcttgagcccggttgcgtcgtaggcggtgccaatgaactgcgcccaacgggcgccgagcttgttggccatgcctgcacgggcattctgctcatggatcacgaccggaatcccgagcctgtgtgcggcggaataggccggcgcagaggcatagccaccgaagccgacgaccacctgggtgccctggtgctcaaggtactgcatcaccttggccttctcagccttccatttgcgggggaattccaacgccgcacggttgggtctgcgggggaacggcaccttctctatcgtctccagttggtacccggcctgtggcaccagatcggcctccagccccacggccgttcccaacgcgatgatgtcggcgtcggggtcgaggcaccgaatcgcgtcggccacggcgagcaacggattgacgtggcctgcggtgccaccacccgcaagcatgatgcggtgctgtgtgttcgaactcatatctccactgtacttgattgtgctctcatatgacggattgcgaaacggcgaatgctatgcgcgcgaatgcgccgccccgatctgcggctgggcgcgcatcaacgagacgcatgcccctgcggccatcagacagaagatcatcgacgaaccgccggccgagacgaacggcaacggaacacccatcacgggaagaatctccacgacgacggcaatgttgatgagcgcctgaccgacgatccacatcatgaagcacagcaatgcgacgctggcatacctattgtgcatctgcatggccaccgccaccagacaccaggcgatgaccacgaagagcagcaccaccagtgcggcacccacaaaacccgtctcctcgccaatgatggcgaagatgaagtcgttatgcgcggcaggcaggtagttccacttctcgcgggaattgccgagccccacacccagcagaccgccggaggccaacgcgtagttcgagtgggtggcttggtagcatacgtcgatgttatcggcggtgcagcccgtataggtcgccatgatgcgtgacatgcggttggagctgaacaccgtaaggatcgccacgcccaccacggccgcaatacccaccagacccacgtacttcatggggaatccgctggccacaatggccatgagtcctatgaggataattaccaatgcggtaccgaggtccttgcccaaaagcaccgaccccaaaccaagcacatataggccaaaggttcgcccccagtcaccgaggtcccacgccttccacgactgccgtatccccggtttcagacgcatcatcgaaatcatgactagtgggaaccacaggcagatcgtgaacttcatgaactcggcgggttggaactggatgcctgcgatacgcagccagccgcggttgccgccaacgtcgatgccgaagaagaacgtgaacacctgaactgccacactgaccaagtacatcggcagggccagccacttcagcgtacgccccttgcagtgtgctgcaaccaacgcgagcaccaggcccaccacgctgaagcccacctggttgagggccttcgcccacggcgaggaacctgcggcaaccatgtcgaccgacgagctcgagaacaccatgatgatgccgaacaccgtgagaatgcccactgcgacgatgaatccatagtagcagcccaatgggttgagcagcacacgccaccctttgtattcgccggcaaagtcaatcatgccgaactgtggtgacggacgtttggaggcgattcgtgctgctgtggcagggtcgtcgtgggtgacggtccatggttggggcgcaccgctccgacggcttcggcgcaccagcggcttcaccgagggaatggcgccgctcgatttgccgtcctgcgccgaacgcatcgaacgaggttgacgttcaggcttcggcatgtccattcacccaccgtttcgcctgggcggcgaactggtcaccgcgatcggcataggatttgaattgatccatcgaggcgcaggccggtgccagcagcaccacatcgcccggctcggcgaagtccgccgcggcatcgatggcacgttccatcaccgtggcgttgtcggctgggtcaatcaccgtcaacggcagctccggcgctttggctttcaatgcctcgagcatcggtttctggtcgatgccaatcaccacgaccgccttgagacgattccgctcctgctccaccagctcttcgaaggtggcacctttggagaggccgccggcaatccacaccaccgaaccgggcgcgaagctgttcagcgaggcacgggccgcatgcgcattcgtggccttcgaatcgtcgacgaagcgaatggtcccttccggcgaagcgagttcagccaccgtctgaatgcgatggcctcccggtgcgaatcgcttgagcgcgttgagcgcagtggcgacgtctgcgccgagacccaccaccagaatcaacgcggtcagggcgtcggcgagcagatgcgggtagattgtaccatcgggttcggcgagatgcgtgaagtccgcaatcggcgccagcgcatatgcctcgccggtctggccaccacataggccgctcatgtcgacgatccagccgtccttgatgccaatctgccccgaaaccggctcccccaacgtgaagccgatgtgttcgcagccctcggcggtctgcgcggtacgtgccagctcgctcacccgggcatcctgcgcgttataggcgatgacccgtttcgcgccatcgaacaccttggatttgtcggtggcatagttcgccataccgccatgccagtccaagtggtccgcggcgatgttcgtgatcgccgcgcaatcgagctctagcgaataggtgaagtgcagctggaaggagctcagctccacacagagcacgtcattgaccgggtcgagtgcggcggcggagagcgcgttgcctatgttacccacggcaggtgccgtatacccgcacgccttgagcatctccgacgtcatttcggtggtcgaggtcttgccgttcgtgccggtgatgccaatccacggagcgggcgaaccggtgcgttcgctgggcactcgcatgcgccaggcgagctccacctcggagatcacctcaatgccgcggctttgcgcctccacaatgaacggcgtgcgcgggttgaacaccggcgacgtacataccagatcgacctcatcccagtcaatgtcgtcgaaggaatgcaggtcggccgcctccagcttctcatcgaccccgatcaccgtggcgccggcatcacgcagaatcttcgccatgctgcgtccggagatgcccagacctgccaccaccacgcatttgcccgccgcgttgaattcctgattactcatttcccacctcgcatgtcttgctggaatgcctcatgtatgtccctctacctataccgccgcggtgtttcggccacatcgcccgctacgccgcaagcttgcgatcagtgatgccagagccccgacagccccacccagttgccgtagaagatgatgagcccggtaatgacgaacatgagctcgacgatccagaagcgcacgaccaccttgctctcgctccagccgcacaattcgaaatgatggtggatcggcgccattttgaatactcgcttgtgcgtcgccttgaaatagcccacctgaatgacgtcgctcagagtctccaccacgaacagaccgccgatgatcatggcgaggaactccgtgtgggtgatgatcgagagtgcggcgaacaagccgcccaatgccagggagccggtgtcgcccatgaaaatggaggccggattgcagttgtaccacaggaagcccaggcaggccacggccgcgcagcatgcgatgatgcccaagtcgagcgggtcggagacggcataggtgaagccggaatgggcctgccccttgagatggtacatctgccacatggcgatgatcgcataccccacgaaggcgatcatggaggaaccggcgcacaggccgtcgaggccgtcgctgaggttcaccgcattggtccaggcggccatgaggaagttcacccagatcacgaacagaatgatcgccacaatcctaccagcgaactcgaagctcaggaatggcttctctatgaagctcatgcctgcctgtgccactgggaatcccgaccgggtgggaacaatgagcgcaagcaccgcgaatatggtggcgaagacgacctgaccgaagaacttgcctcccaccgtcaggccctcgttttgcttcttgcgtaccttggcgaaatcgtcgatgaagccgaggacacccatcgaaaccatggcgaacagtgcgagaatggccgcccaagtgggccgtgcccccgtcgtgcagaaacggtacagggcagaggcacaccagccgagcaccacggccagcacgatgaccacgccgccgagcgttggcgtgccgcgtttgacctgatgcgacttggggccgtcctggcggatgtactgaccgtaattgagcttgtgcacaatgcggatcagcaaaggggtaccgacgagcgtgatgatcagcgacgtcagaattcctatgatgagggcgatcacgaggttactccattcgtgggtgttgttgccttgtagttgttgggttccgtgttattcggcctcggcggcccactgtgtcgccaacgcgctcagacctgaggcgtgggaccctttgagcagcaccagcatgtcggggtgttcggcgttgagtgcgcgaatcagatcatcggcctgctgagtggtcttcaccgcccgaaccggtcgcatgtcgtctgcatccttcgcctcggtgccgccatccgcaatgtcctgcgccaacgcgttgagtgaggcgtcatcgccgccacccacgcagatcagcgcatccacaccgccatcgagcgcgtaggcgccaatcgtcctgtgcaggttatgctcatcggagccgagctcaagcatcgagccgagcacggccacacggtaaggctgctgatcctcctggctacgccatgccatgaggccatcgattcccgcgcgcatggagtccggattcgcgttgaaggaatcgtcgatgagtgtgaatcgtgcaccatcccgctccacctcactcaccgccatgcgatgcgggctgatcctgcgggtatccgccaacacctgggcaatgcgttcgagcggcatgcccagcagcttggccacgctcgccgcggccaacgcattcatcacgttgtggcggccgccgatgccgagcgacacacgctgctccactccctgcgaggacacgagttcgaacacgggatgccccagatcgtccaatgcaatgtcgtcggcagccatatagccgtcgatatcatgtgcctgcgccttgtcgatgccgaaccagaacacatcgcccttggcaatcccgctcatcgccgccacacgctcatcgtctgcattgagcaccgtgatcgcattcggcgcctccccacgtacgatctcgctctttgcctgggcgatgcgttccaccgaaccgaattcacccaaatgggcgacgcccaccttgagcactacagcgatgtcaggcggtgcgatcttcgtgagcctggcgatctcaccgatgtggttggcccccatctcagccaccaggtatcgcgtgcgttcccccaccttcagtgccgtcaaaggcagcccgatctcattgttgaacgatcccttcggtgccacggtctcgccttgcgtgctcagcaacgcatggagcaggtccttcgtggtagtcttgcccaccgaaccggtgatgccgatgatcgtgaagggctcatcgatggccttgcgcgcctcgagattggctttggccaacgcccccaacgccgccaccgtatcgggaaccacaatctgcgcgatgggagccgacttgatctcacgctccaccagcgccgccgcggcgccttgccgtgccgccgcatccacgaaatcatggccatccacatgctcgccggcaatcgccacgaacagcgccccgtctacgacctgccgtgaatcggtcaccacgctcgtggcggtcaccgtctccaggtcatcgcagtcgcaatgctccgcagagccatgcacggcttgcaccatctgcgccaacgtcattcgcatcatgtctgttcctcaccgttcctttcgaaaaatcctgcgctcagtgcagttccctcgacacccgcagagcgctgcgaatgttcgctttcttcacgcctgcagccatcaccatggcaatcgccagcgacagcgacctcaccttgtcgagcccgaaatccgcttgcacggccatctgatcggtctcatcggtgcggaaggcgatatgcgtgccttcatcaatgccgcagccataccgttcgcaggcctgttccactaagtcctgccctgccatggggttggccacaccgtcatagccgatcacatcggcccccaccgattgcagggcgtcgggctgcaacgtgttgtcgtccaaggcgagaatcaccgcggcggcgccatcctcggcgcataccgagagcacccgctgcatggagagaatatccatcgggtacctcaaatcgaggaatcggtccaacgactgcgagtcgccggcgcagattgtgcccactggattgccgagcatgtgcaggaactgggagagcatctccacattggcatggatctggtcatcgttgatcccggcgatggcgaacaccgccaaagttcccgccggattcccggtcatattcgatgcgatctggcctatctcgcgtggggtcgggtcggcgtacaccaaagggatgtcggcttccagatcgctcgatctcatcgacttcgggagcatcaccgcataggcgcctttccgtgaggcggcggccaccctggcggcatcgatgcgtttgcccggcataaacaacgatccggcggtcaccgaatcgatgtcgctggccagtgacgtgacggtgaccgcgcgggagaacttcggcgagagctcgtacccgtaccggtctgcaagcatgcccaatgtggtgcggtgcgtggccgcttcgctcagtgaactcatatgaactccttgcctcaccattccaccgggatggcgtccttgcgcggcgtggatgccggcacttcatacttctgcatgaggaactggcctatctccgcggtgaccgggccggcggtcagaccgccatagttgccttccgggtctcgaagcaccacggtgaccacatagcgtgggttgtcggctgggatgatggccgtgtagtcgctgatcagcgatgacagcttgccgtcatcgccgacgatctcggcggttccggacttcgaggcgacacggtagccgctcacgccggcgaacttctggtagtgctccgccaccgattccatggcgttgagcagctcattcgccacgctttcatcgacgacgcgtttggattcgccggggttgaccttctcctcgcgcccgttggaggccgtgaccgatttgatgatgctctggggcttcatcacgcccttgttcgccacgacggctatggcgttggtcagctgcagcgcgttcgtggagtagccctgaccgaacagcacggtattgcgggtacggccgtcccatgcgttcgccggcgtgagcacgccctgcgattcaccgggaaggtgcagggaggagggttggcctatgccgaatttcgacagatactcgtagcgcttgtcgtcggggaaattgtcggaggcctggatggtgcccacattcgaggattgctcgagcacaccggccagcgtccaacgctcggcgccatggttgaacgaatccttgtaggtctgaccctccagcgtgatgctgtcaggcacggtgaaacggtcacccatatggtgcagcttctcctgcaacagaccgcccatggtgaacaccttgccaatggagccgggctcgaacacctgattgacgcttcgcgccacctgcaccttggcatcgccggatccggcctcgatcttgtcggtgtcggccagggcaatgatctccccggtgcgaacgtcctccaccacgccaatgccccagcgcgccttgtacttctcctgtgcatcggcgagaatcttctccacacgccattgcacgtcacgatcgatggtcagcgtcacattcgagccatccaccgcctccttcgagtcggtcatcgtgccggggatctcctcaccgccgttaccttgctggtacacctgatagccgtcggtgccggtgagtgtcttgttctgcagctgttcgatgccggcgaccccctcgccctcggcattgacgcccccaagcaacgctcccatgagcgtgccgttcgagtacaggcgttcattgctcagctccgaatagacaatgcctcccaagtacagctgcgaaatcttgcgtttgacctcgggcgtcacgtctttcttcagtacggcgtactggcctgtgcccgacagcttgccgcctatctccgaggcgctcatgccaagcagcggggcgagcagctgggagaccgcggccacacctgtggtggtcagcggcttgccgtcgagctgctggcaatacggcttggtcgctgccgtacatgccgtcggttcgaaggtctgcgccgcatccggattgcctatgatcgtgtagcgctccacgctttgggccagcaccacgccgttcgtgtccatgatcttgccacgcttggcctgcaacgtcaccttgagcgtacggctctgctgggcggccatggccaattgcgggccttcgatgagctgaatgtacaccagcttgccaaggcagcacacggccagcaccgccatcaccaccgtgatgacgatggtgcggcgcatcaactgcgaggcgccattccatttggctttcaggcctttcattcggtggcacctccctgactggtgtcatgctggtttgacgtcgcctgctgctcggctgattcccctgttgtcgccttctcatcctttggcggctggtagccattgagatctatcgtgagggatcccgaggcaggcaccatattgagtttctgcgcacgatccggcaacgtggcctccaggttcgagagcttcgcctgattatcttccacatcctgccgaagcatcgtgatgttctgctccacttgcgacgattcgaaggagttctccaccatctgggtgcgcagcatcaacgtgccgatccagcacagcaccagaaacagaatcgcaatggtggtgtgcagccatgggcgcgggcggctacgcgtccacgcgatgacggtgctggccacatgagcgccatgccccgtctccttggcatggtgctctccggactccaccacgtgcagatgcgggcgcttgagtgccggatctgactgcctgcccgcaggtgacacattcgaacgtgtcgatcgcattggaaccgccatgttatcccctcctcgcctgggtacggcgccggtggccatgtgctccgcggacaccgtcctccgacccttgagattccagttcgaaggcatggacccaacgctgcggcagcggacgcgtaagctcgaccgcgcgcaatcttacggacgcgctgcgcggattgtacgcgatctcgccggcatcggctttcaccgctcccttggtgagcgccttgaagaaaggctgcatgtccggcggaatcaccggcatatctgccggggcgtcaacccgcaacccctgcgccatgaaattcttcaccgtgcgatcttccagcgaatggtacgactccacaaccaagcgaccgccgacagcaagatggagcccaatctgaggcagtgttcgccgaagcttgtcgagttctccattcacttcgatgcgcagtgcctggaacacacgtttggccggattgccgctaccacgcctggcggccggaatcactgcatcgaccaaggcggtgagctggctcgaggtctcgaggggactgctctggcgctgctgtacgatgcgcttggctatcggcttgctgaagcgctcctcgccatactccttgaatatatgcgcaagccggtccgcgtcgtaggtcgcgagaatctcgcgggccgtcaacgcctgagaggtgtccatgcgcatgtcgagcggcgcatcatgcgcatacgagaacccacgttcgcgttcatcaatctgcagactcgacaatcccaggtccatgaacacggcctgcacccggctcaccccctgtgcacgcaacacctcgtcaaactggtcgaaagcggcgtgcaccggaacgaatcgtgcggacaacccctcctgggcaatgcgtgcggtggccttgtccaatgcctcctcgtcacggtctatgccgatcaccgtggcgttcggggcggccttgaggaacgcaatcgtatgcccggccagcccgagcgtgcagtccacggcgacggaatccgaggcatgcaaagcgggagtgacgagatcaacgcactcctgaagaagcaccggcttgtgaatctgcgagaaatcggtcatcagaactccaagtccggcagcacatcgtcggcaatgtccgaatattccggctcgttgtcactcaaatactgctcccacgccttcctgttccatatctcggcgcgcgtacccacgccgatcaccacaatgtcgtcaccgagatccgcatactcgcgcagcatctgcggcaccaccacacgcccctgcttgtcggtgtcctgatcaaccgcgccgctgagaaacacgcgcagatactgacgtgccgccttgttgcccaccgagacgcgctgaatctgtgcggcgatgcggcggaactcagactgcggcagcagatatacgcagcgttcctgcccgcgcgccatgaccatgccctcaccgagctgcgcacgcatcttcgccgggatggccatgcgccctttggcgtcgatcttcgggttgtacgtgccgagtaacagcggaggaaccaccggtgcggaggagtccggctcgactggttcgtcggtcatggctcctcctatcaacacgcatgcgaactcttcgtctctccactctaccccaccactcacctaaattccccaccacacacccaaaaccgacgaaacacgcgtttcttcacaaaaaactccgcttccgacaccactcatggcgcactgacagcggcgtccaccgcctcaggcactcgaaaagaaccgcatagaatacctgaaaattcattttttccactcaaattgcaatccggaaagattgatttcgcccattgcgatgccatacggattgttcttccgggcatacgcccccacggtagccgccgattggtaagatagtgtggcttcagtcagactagggaatgtacgggaacatgtcacagtactcttcgcagattcaggaagaacaacaggtagtggaccgcgcctacggcaggctcgacgaccttcgcacacaggcgcgcgaacgcctgagcgacgtgcgcgcggccggatcccacggctcgcccacgcaacgcaccgaacgtgactccttcgccaccatgtacgaggatcggctcacccagctgcgcgccgtcgaggaccgtctggtgttcgggcgccttgacgacgagtcggggaaccgacgctacataggtcgcatcggcctttccgacgagaaccatgagccaatgctcacggattggcgcgccgaggctgcacggccgttctacgaggcgactccgtcgcatcatggcgacatcgtgatgcgtcgccatatcacgttgcacttccgcgaggtcgtgggcattgaagatgaggtgctcgacgtgcattcaccccacgtcaacaccgcgtccgagcagggaacgctcacgggcgagggcgcccttctggcctccctcgggtcacgacgcaccggcaagatgaccgacatcgtggccaccatccaaggcgagcaggaccgcatcatccgcgcggcactgcgcggggccgtcattgttcagggaggaccgggcaccggcaagaccgcagtggccctgcatcgcgccgcctacctgctctacacgcatcgccgtatgctcgaccgttccggagtgctcgtggtcggccccagcgaggagttcctgcactatatcgatcaggtgctgccgtcgttgggagagacgggcgtggtgagccgcacgatcggtgaactgattccgggcatggtggccgagcgtcacgacgaaccgcatgtggcacagctcaaaggcgaacgccgcatggccaatgcaatcgccaacgcggtggcggcgcgcgaacgggtgccggccaatctgcccaccgtgtatttcaacggcattccagtcaccatgagggcagccgacgtcaccgaagccatcgctgcggcacgacgcacccgtcagccgcacaacaaagcgcgtgagaccttcgtgaacgagatgctcgaacgcatgcgctcccagtacatcgaacagctcgactacaccccggaggcggctgaggtctccgacttcatgagccagctgcgcctttccgatcccatccgcatcgcgctcaacctggcatggcttcccatggacgccaaatggatgctcgaccagatgctctcgaaacccgcgcaactcaagcgctacgccccttggctcaccgaggcgcaggtacgcatgctcacgcgtgaacgcggcgccgcatttacacgttccgacatcccgctgctcgacgaggccatggaactgctcggccccgaccctcgcgatgctgcacgtgccgcggcgcgcaacgccaagcgggaggaggaggaacgcttcgccgccgacaccttggcgcagaatggcatcggctcgggcatcgtcaactcgaagatgctggtggatcatatgaacggcggcgatgccgaactggtggcgcaacgtgctgccgccgatcgcgaatggacctatggccacattgtggtggatgaggcgcaggaactcactgccatggactggcgcatgctcatacgccgttgcccctcacgctcattcaccattgtgggcgatgtcgcccagacttcggccctcggcggcacgcgcgactggaagaagacgatgacaccactcttcggcgagcataactggagcctcaatgaactgacgatcaactaccgcaacccgcaggaggtctcaaacctcgcctcgtctttcgccgagcgcgaaggactctatatttccacagtcaaggcgattcgctcgattcccgactcggtgcagcgtctggtggtggacgacgacacgacgatgtacgacgaactgagcttccacgcggcatcgctcgccaaggaattcattgacagcgacggcaatggccgtgtggccgtcattgtgccccaggaaatcaaagacgccgcccgcagtgccatctcacggaggttcaagcgcatcgccgacaccagtcagatgcacatcgaggattcccagttgctggtctgcgacgcccagtcggtgaaaggcctggaatacgatgcggtgattgtggcccagccgggactgattgcacaggaggccccaagtcgtctggctgcggcggctgatctgtatgtggcgttgacacgcccgacccagcgtctgcttatagtacggacaagagaagatgaaaacctactgaccctttaaggtgggaagcatgcctaaagctctactgttggaaaacattcatccactcgccgcggagagccttcgcgcccacggattcgaagtggagacccgcaagggtgcgctctcggaacgggaactcatcgacgcgctcgagggtgtcgacgtgcttggcgtacgttccaagaccacggtgacccgagcggtcatcgatgcacgccccacattgaccgccatcggctgcttctgcatcggcacgaaccaagtggacctgaaccatgccgccaagaacggcatcgctgtattcaatgcaccatattcgaacacgcgttccgtggtggaactggtgatctgcgacatcatatgcctgatgcgacgcatccccgcccacacacaccacatgaagcatggtgtatgggacaagtctgcttccggctcccatgaggttcgcggcaagaccctcggcatcatcggctacggcaacatcggttcgcagctctcggtactcgccgaggcgctcggcatgagtgtcatcttctacgacctcgaggagaaactcgcgctcggtaatgcacgtcgatgcgaaacgctccacgagctgctcaacgaggcagacgccgtgaccatccacgtggacggccgcaagtcgaacaccggcttcttcggcgagaagcaattctcgcagatgaagcagaacgccatcttcatcaacgcctcccgaggcttcgtcgtcgacctcgatgcactgaaggagcacctagattcagggcatctttcaggggccgccattgacgtgttccagaacgaaccgaagaagaccggcgacccgttctccacaccgctggccgatgaggacaacatgatcctcaccccgcacatcggcggttcgacgctggaggcgcaggagaacatcgcgcagttcgtctcccaaaggcttgaggattattggttcaaggcatcaaccatgctctccgtgaacctgccgcaaatcaccaccggtccctgtaagggagcggcacgcatcgcccatctgcacgccaacctgccgggcgtgctggccaaggtgaaccaggtgcttggtgagcaggacatcaacatcagcgcacaagcgctcggaaccgaaggcgagatcggctatgtggtgaccgatgtgaccaagtgtcccgacgaggtcaccatcgacgcgctggacgccatcaccggcacgatccgcacccgggtcatcgaaagctgatacccacagctgatgctggtttccgcttgcccggctggacaagcggaaaccagcatttattccgaatccctcagtgcatcgatggcgtgctggaaatcctcgagatcttcgaagttctggtacacactggcaaaccgcaagtaggcgacctcgtcgagatctttcagcggtctcagaatcgccttgcccacctcgtcggacggaacctgcgccacgccacgggcacggagatcctcctccacctgctgaccgagtcgtttcagatcatcctcgtgaatgggcctgccctgacatgctttgcgaacaccggcaatgaccttgttcctgtcgaactgttcgacgttgccggaccgtttcttcaccaacagcatcgtggtttcaagcgtactgaagcgcgcaccgcaattggggcattcacgacgccggcgaatcgagtggccgtcgtcgctgattcgggtatcgatcaccttggtatcgggattctggcagaaaggacaatgcatactccaagaataccgcgcccacggcccatgttcgcattgccccgaatatattagcgcatgacgtgtcatgatatgacacctgatgacatagcactcacaacggaatcaccaggtgctgacccgcccgaaggctgcccccacgcagattgttcacctgtttgagccgttccacccgctggtaggcactggacgaatcaccggggaatctcgaagcgatgctccacaacgaatctccaggttgcaccgtatagtgcacgacttccgaggaagccgcctccacaacagcatcgctttcacgcgcgccagcagtcacacaacacagcgcgaaacaggccgatatagtcaccaccacggcaagaacacggtgatgtgcgcgaaggaaggaattccgatatcgctcgctcaccgtcttcgcctgcacctgcacaatcgacttcgaacgcatgaccactccttcgaacaaatgttctaacagctgcagtccatattcgcacatctgttcgacgatgtcaatccgttcgaacatctgtttgatttttcaggcgtttcgcggtagggtatgcacataggaaaggacacgacatgagcaacctcgacgcacccacgccggccggaagccgaccgagcctggaatcactcacgaaacggcagctacaggtactcgatgccatccgcaagctcttggaggaacaggggttcgcgccgtcgttgcgggaaatcggcaaagccgccaacctcaagagcacatcatcggtgcagcatcagctccatgcattggaaagcaaaggattcatccgccgcgaccccaataaaggccgggccatcgagcttgttgagacacaggacggcacatccggcggcaatcccatcgttcccttcgacggcatggatttggaaccatccgacttcctcgacgtccccctggtcggcgccatcgccgcggggcagccgatcaccgccgagcagcatgtggaggatgtcatgcgtctgccagtgcgtctcaccggaaccggcaatctgttcatgctcgaggtcaaaggcgactcgatgatcgacgcggccatatgcgacggggacttcgtggtcgtgcgcgaacagcacaatgcagagaacggcgacattgtggccgcgctgcttgacgacgaggccaccgtgaaaacattccggcaggagcacggtcatacttggctcatcccccacaatccgaactacgcacccatcgacggcacccatgcacagatcatgggcaaggtcgtcaccgtactacgcaaaatctgacggatcaacattgtcggaaggaaccggcgactacagacttacccctgtgttgacctaaatgggaccccaaagcattttgccgtagggtcccattcatatctcttaccctcttaccctcttccccatcctcgcatcgccatccatcccacatctgggagcactccatccccggctgccccgatagggtcacagcatctcgtggaatatggtccgtaggcaaacgcgaccaatacaaaacgaccatagtcgggccaactatggtcgttcagcgaacgcatccatcactcaacgaccataattcatcaaagtatggtcgtttatgcaacaagtccgtcacgaaacgcccatggcaaccgctccgccaatctgcatacggcggcgatcattcatggatctgccccacgtcgacgttcgaatacccctccggctccagctggaatgtggtatgcgcgatcgacaccgggaaatgctgtcgcgtgcaatcctgcagctgtctgagcacctcgcctgcctgggccacggtcagatccggctcaacaatgacgtgcgcggtgagaatgggcatgccggtggagacgacgctcgcatgcagatcatgcacggccagaacgtgcggcacgcccagcaagtgctcgcgcaccgtgtcgagatcgagaccatccggcgtctcctcgagcaacacacgcatcgcatggtggagcagcccgtaggcccgcgggatcatcagcaatgcaatcagcgcgccggcgatggcgtcgaatccgctccaacccgtgcacatgagcacaatgctcgagatgatcaccgcaaccgagccgagcgcatcattgcacacctcgaggaacgcggcgcgcatgttcatgttgtcattcgactgtgctcgcagcacgaacatggatccgatattcgaagccaagccgagaatgccgaagaacaacagcagccgaacatcgtgcacggactcggattccacaccggtgagcctgagcaccgcctcgatgagcgcatacaggcccacgaacatgagcaccagtcctccaccggcggcggtgatgatctccagacgggcccagccccacgtcttcgacttgtcgggcttgcgacgcatgagcgcggccgtgacggtcgatgcggtgagcacggcgacatcggtggtcatatgccccgcatcaaccaacaacgccaaggaaccggtgagcgcagcacccacgacctcggccaccaggatcgtggccgtcagcgccaaggtgacgatgagtcgtttgaagtgcccttcggtgccgttcaccggtgcgtgggaatgctcgtgcgccatctctccccccatattctcgtgtcaagtggtgtatccagtatgcgccgggcatccgtgacacgccagaaaaagaaatgccgccgaataatcggcggcactcatatcatcgcgaatcagaagccgaactgggcggccgtctcacgcagcgtctcggcggagcgcttgagggctgcaagctcgcggtcggaaaccggcgtattgatgcgggagtttacgccgttgcggttgagcaacgtaggaaccgacatgcacacgtcggaaatgccatggaagtcgctcagcagcgacgaaaccggcagaatgcggttggagtccttgagaatggcctcgatgatgtcgacgccggacatggcgatggcgtagttcgtcgcgcccttgccgttgatgatcttgtaggccgcgttcttcacttcctggtggatgcgctcgcgagcctcagcatcgagcggctcatggcccggcagtgcctgccaatcgcacatcggaacgccgccgatggtggcggaggcccacagcgggacctcggaatcgccgtgctcaccggcgatgtatgcgtgcacgttcttgacgttcacaccggtctgctgggcgatgaggaagcgcagacgagcagagtcgaggttggtgccggagccgaacatacgtgatgccggcagaccggagagcttcatggcgacatgggtgacgatgtccaccgggttggtgatgagcatgtagatcgcgttcggggcgaccttgagcatgttcgggatgatcgacttcatgatgttgatcgtggcaccggccagatcgaggcgggactgacccggcttctggcgtgcgccggcggtgatgacgaccatgtcggcgtcacggcagacctcagggtcgtcggagccctcgatggaaacggtcgggaagaagctggaaccgtgctgcatgtcgagcacctctgcctcgacacgctccttggcgatgtcctgcaatgcgatctcacgggcgatgccacgctccgcagccgcgaacgcaagagtggaaccgactgcaccggctccgacgatggcaagcttggttggcttaattggcgaattcaccatactgacgacctctcatactacccgcttatggcgggattcacatatctttcacctgtactttagcagaatcgcgccacagcggtgcctctcgcgattctttttatagttcaatgcgaacacaatacgagcatgtttcaacgagccgtatacaccacagcatcggtgtgatctgcatcactccccgccctccccgtgttccggggcatccgtctcgtgcagggccacgtccatgattcgcgccgccagtctttcgtccacaaaagcctgcagcataatgccgtcatcgcggtattccagcgactccaggcgcccatactcgcggaccttcgccagcaacgatccctcggtgtatggcagcaacgcctcgacatgcacatccggatcgacgagcatcgactcgacgtcggcccgcaatgcgtccacgccctcgccggtggcagacgaaacgatatgcgcatcgggtgcgagcgcatgcagacgctcgcgtttggcatcgtcaatgaggtcggccttgttgaacacggtgatcaccggcagtcgctccacaccgtctatggtctgcagcacctcgttcaccgcgtcgatctgagagaacggatcggggtgcgaggcatcgaccacgtgcacgatgaggtcggcgtctgcaatctcctcaagcgtcgatttgaacgcctccaccaaattagtgggcagccggcgtacgaaaccgacggtgtccacataggcatagagtcggccgtcgcgcgtctgcgtgcggcgcaccgccgtgtcgagggtggcgaacagcgcgttctccaccagttcggtcgaaccggtcagccggttggtcagcgacgatttgccggcattcgtgtaaccgacgacggcgatggtaggcaatccgtaacgtcggcgtgatccgcgcttgacctcgcgcgtgcccgacatctccttgatctgcttgcgcagtctcgcgatgcgggtgcggatcacacgacggtccatctcgatcttcgtctcacccgggccgcgggagccgatgccggcgtcggcaccggcggcccggccgcccgcctgccgtgacaatgcggcgccccaaccgcgcagacgcggcagcatgtactgcaactgcgcgagctccacctgggccttgccttcacgagaggtggcatgctgtgcgaagatgtcgaggatcaccgcggtgcggtccaccaccttgacgtgggtcagatcctccaaggcacgccgttggctcggcggcaggtcggcgtccacgatgatcgtgtccgcgtcgttcgcggcgacgatgtccgctatctcacgcgccttgccggaacccacatatgacgtcccatcaggccgtgaccgctgctgcagcacgccgtcgcacacctcggcgcccgccgtctcggcgagcgcggcgagctcgcgcaacgactcctcggcctgcgcgaacgtcgactcccgggaagaccacacccccaccaatacgaccttctccagccgaaccttgcggtattcgacctcggtgacgtcttcgagctctcccagaccggccacatgcttgagctcgttgcgcccttcacgctcgcgccaggtctcgtcctcaccccgccagccggcgtggtcgtcgtcgagcagcacctgcgactgcccgtcgagcacgttctgcgaatctgtggtctgcgaatcctcggtatatctcgggttgcccatgcggcccccgttctcgaatatggtcaaaagcgcctttcttttgaactgcaagcgttcttatatcatggtacgtatagtgaacaagacaggtacggcaaatatttcagtatttcatggaaacggggatgtcatgggcaagtcgaatggcacggcgaacgaacagtacttcagctccgcgccacagtccgccgatgtacgcaagacactcgaggtgacattgcgcgaccatccggtcaccgtcgagacatccaatggcgtcttctcggcacaccgcgtggatcttggcacctccgtgctgctccggcatgcgcccatgcccccgcttgagggcacgttcctcgatctcggttgcggctggggtgccatcgcgctcgcgctcgcattggaatcgccggaggccaccgtatacgcggtcgatgtcaacgaacgcgcgatcgaactggcacgcagcaacgccgaggcgaacggctgcgggaatattcacgccggcactgcggctgttgtacctggtgacgtgcgcttcgacgtgatctggtcgaaccctccgatccgcatcggcaaggaagcgctccacgaactgctcatggagtggcttccgcgcctcgtctccgacggccatgcctatttggtggtgcagcgcaatctgggctccgattcgctcatcccctggcttgccgagcatctcggcgacggctacgaagtgggcaaatacgccagttcgaagggctaccgggtgattgacgtgcataagctcgcctagcacagcgcaatacctgaacaccgattatcttcagaaagacgttatgaaattcgaataccccgatcagctgcctgtctcggccgcacgcgaagccatcgccaacgcggtgcgttccagtcaggtggtgatcatctccgggcaaaccggttccggcaagaccacgcagctgccgaagatcctgctcgaactcggtcgcggctcgcatggcaagcagattgtgcacacgcagccacgccgtctcgccgcgcgcaccgtggccgaacgcctcgccgacgagatgggcgtgcgcctgggcgacgaaattggctaccaggtgcggttcaccgacgaaagctcgccgaagacacgcctgcgcgtggtcaccgacggcattctgctcgcgcagatccaacgcgatccgaaactgacacgctatgacacgatcatcatcgacgaggcgcacgaacgcagtctcaacatagacttcctgctcggctatctcaccgccctgctgccgttgcgtcgcgacctgaagctcatcatcacctccgcgacaatcgattcggcgaagttccagaagcatttcgaagacgcactgcgcaccgaggtaccggtaatcgaggtctccggccgcacgtacccggtcacgatctgctatgagccgctgggaggcactcccgcgctgatgaggcatgttcccgggtttgcggacggaacggccggcgacgacatcacgaacccggacgccgaggcaatggacatgcccaccgcggtcgctcgcgcatgcaccgaattggcgattctctccacgcatgaccaaggaccacgtgacattctcgtgttcgcctccggcgagcgcgacatccgcgacttcgagcaggcgctccgccatcatttcggcccgcgtgccgccgacatgcgcaggccggacgccatcgagatcgtgccgttgttcgcacgtctgagcgccaaggaacagcatcgcgtgttcgaaccgcatacgcaccagcgcatcgtcatcgccacgaacgtggccgagacatcgctcacggtgccgggcatacgctatgtggtggatccgggtaccgcgcgtatctcgcgctattcgaagcaggcgaaagtgcagcggctgcccatcgagccgatctcgcaggcgagtgccgaccagcgttcgggtcgctgcggccgtatcgccgacggcattgcgatccgcctgtattcgagtgaggattacgagtcacgcccgcgtttcaccgagccggagattctacgcacgtcgctcggcgcggtcgtgctgcacatgctctcggtgggcgtggcgaggacggcggaggacatcaccgatttcggattcatcgacccgcctgacatcaaggcggtctccgacggcatcaacgaactcaccgaattgcgtgcgatttctcgcaaacgcggcgtcatgcaactgacgcacaccgggcgccagcttgcgcgcataccgattgacgtgcgtctgggccgcatggtgatcgaggccgcccgctccaccacgccgaacaccttggccgcagtgctcgtcgtcgtggcgttcctgagcctgcaggatccgcgtgaacgccccgaggagaagcgcgaggaggcggattgcatccacaaccgctacgccgacgagaccagtgattttctcaccgcactgaacatatgggaccgcgcatatggggcggatggcgagatgagcagccatgcactgcgcaggctgtgcaagactgaatacctgcatttcctgcgtatgcgccagtggagggatctcgtctcgcagctgcgcgaactgtgccgcgaactcaagttcaatgtgggcgaaccgattccggtgtcgcgaccgccgcgtgagatccgggaactgccgatcagccagcaggctgcgcattcgctcgcctgttcatgggacagccaaggcattcacacctccatgttggccggtctcctctcgatgatgggcatgcaggtcgtgcatgagccgaaggcatctgatttcaccggtctcaagggtgccgcccgagcgcgggcgatgaaacgtgcacagaagatggcgaagaacgattacttgggtgcgcgaggcacgcatttcgcgattttcccggcgtcggcactctcgaaatccacgccgagctgggtgatgagcaccgaactcgtgcagacgagccggttgtgggcgcgctactgcgctgcaatcgaccctgcgtgggcggagccgctcgccggcaatctgacccgcaccacgtatgcgaacccgcactggtccgcctcacgtggctccgcagtggcggaatcgaatgtgctgctgtatgggctgcccatcgtgcaggggcgcaccgtgcagtgggggcgcatcaacccgctcgaggctcgtgatttcctgattcgtcagggacttgtggaaggtgagattcagcagcggttcgcgcacgacgagttcatcgacgccaaccggtcggttatcgaggaggcccaggaggagtcgaatcgcacacgtcaggtggcgcagacggtgagcgacgaggatctgtacgatttctacaacgaggtgattccgaacacggtgacctgcgtggctgacctggcgaaatggtggaagggcgagtttgaggctcacccgcatctgcttgatttcgatccgtccaaggtggagcggctcctcgatcaggaatcggtgagcatggaggacttccccgaccactgggtcgccgtcggttccgacgagcgtgtgattgagctgcggctgagctacgtttacgacacgcacgatcctgcggacggcgtcaccgtgcacattccgctcggcgtgctctcacgcatctcggcaccgcagttcagctggaatgtgcccgggctgcgtcatgagctcattgtggcgatgatcaaggcattgccgaaggcgctgcgcgtgcagttcgtgccggcgccagacaccgcgacgaagatcgaggactggatcgactcccatttccaaaccgacccgggttccggcacactggattcccctgcacaggttgacgggggcgtgtggccggatttcgcgcacgtgttcacacaggccgccatcgaggtggtcggggcgcagattcacccggaggtgctcgatggcctcgccgacaagctgccgccatacctgcgcatgaatttcgtgatcgagcagccgaagccccggccgaagcgtgcccaccgccgccgttcgtacgacgatggcgtggtggtgctcggcacaggcaagtcgctggtcgagctacagcgccagtttgccgaacaggcgcaggaatccgcacgcaaaatcgtgcaccggcaggcccagaaggccgccgagcagggtcaggtggtggccgaggcggatctgctgcgcaaagccggtgccaccacggaggcgcgcgaggagatgctctggcgaggggcgctcgatcggctgcgcctgcctgccgaacgcatctcgtcacgctggctcggtgccgaggccctcatgctcgcatcggctccgtattcgaccacgaaggcgctcgccgacaacctgcagttgcagacggtgaagcgattgctgccagacattgcgaaactgagctccgacgaggcgttgagtgaggccgtggatggcgtcaaagaagtgttcgaggacgccgtgtatgaggtggccaaggacgcgatcgaggtgctgcgggcctatgcgcaggtagacaaggcggtcagcggcaaggccgacctgcccatgctctcggtgctgcagtcggtgcgcgaacatatcgccacactcgtgcatcccggtttcatcggcgccacgccgcccgattcattccgcagactgccggtctacctgcaggccgacatgatcagactctccaaggcgaaaaccgacaagaaccgcgatgtgcgctgggcgtggcaggccgacgaagccaaacaaatcgtcgacaaagcgctcgaaaaggcacgcaaggagccggccggggccaagcacgacgagctcatggccaaggcgctcaaggcacgctggatgctcgaggagttctacgtgtcgctctgggcgcaagagctcggcactccttacccggtaagtgtgcagcgcatccagaaggcactgcgttagtttccccatgtgcatgcatatccaagcggcggggtgttccgaatcacattcggaacaccccgccgcttttctcgtcacattcacattgacagctcagagcttggccaggtacttcttgagttcgaagggcgtcacctgactgcggtactcctcccattccttgcgcttgttgcgcaggaagaactcgaagagatgctcgccgagcacatcggccacgaaatcggatttctccatgatcttcagggcctcgtccagcgactcgggcagcggctgaatgcccatcgcctgacgctcggcgtcggtgagctcccacacgtcatcactcgtaggctcgcccaaggtcatcttcttttcgatgccatcgaggcctgccgccagcagcaccgaataggcgaggtacgggttcgcgcccggatcgagcgcgcggaactcgatgcgcgcggagttgcccttgcctggcttgtactgtggaatgcgaagcagagccgaacggttgttgtgcccccagcagatgtagctcggggcctcgttgcctccccacagacgcttgtaggagttcacgtactggtcagtgacggcgcagatctcggcagcatggtgcagaatacccgcagcgaactgccgggccgtcagcgacatgttgaactcctgaccggcctcgtagaacgcgttcgcatccccttcgaacaggctcaggtgcgtgtgcatgcccgaacctggcgcgtccgcgagcggcttgggcatgaaactcgcatggatgccgcgttcgagagagatctccttgaccaccgtacggaaggtcatgatgttgtcggcgatcgtcaacgcatcggcataccgcaggtcgatctcattctggccggggcccgcctcgtgatgcgagtattcgaccgagatgcccatctgctcgagcatgttgacggtggcgcggcggaaatccatgcctggactgcgtggcacatggtcgaaatagccgccctgatcgatcggcacggggctcttggaccagtcgtcctgcttctcgaacaggtagaactcgatctccgggtgcacgtagaacgtgaagcccttctccttggccttcgacagcgaacgcttgagcacatggcgtgggtcggagagcgagggctcgccctccggagtgagcacgtcgcagaacatacgcgccgtgccttggggacctccgcgccacggcagaatctggaaggtgctcgggtcgggcttgacgatcatgtcgtcttcagacacacgcgtcatgccttcgatcgcggagccatcgaaaccaatgccctcctcgaatgcggcctccagctctgcaggcgcgatggccaccgatttcaatgttcccaatacatccgtgaaccacaggcgaatgaagcgaacatcgcgttcctcaacggttcggagcgcaaattcttgttgtttgtccatagcaccccatcgtttcaaaccgatgttacggcacgcgttaacagacggtatgtggacaccgcatcgatatacggacggaatccgcacggaacgccgtataaacacgaattgtgcctgcccgcacggtattgtgcaagtatgagcgatggaaatcttgtagagtcaagcgaagcgcatccgatgttcgacatgagcgcatggacggagttcaagaaccccgaggatcgcacgaacgccggtctcaaactccgcgaacgcttccctctctcctcgcatgccgtatggcgcgtgcaaacgaagcggcgtgacgtgatcggtctgctcgaggagcagaacaagatgcgcgttcccgacctggtgccgctgcggttcaagcgcatgagcgcaaacgccttcaccttctaccgagggggcgcggcgatcatggcgaacgatctcgcccgcacccctaccacctgcattccggtgcagtgcataggagatgcgcacataggcaacttcggcatcttctattcgccgtccaaacgtctcgtgttcgacatcaacgacttcgacgagacggccacgggcccatgggaatgggatatcaagcgacttgccgtttcggtggagattgcggggcgcaacatagggctcaaggagaaggagcgtcatgatgccgtctatcgttgcgtgaaacagtaccgtgaaacattacgggaattctcgcagatgggcttcctcaacacgtggtacacccatttcgatgtagaagacagcctcgcccatctggagaaggcgatgaaagcgaagccgtcgaaaacgttgcacggcgccatagccaaggcgcgttcgaaggactccaagaaggcagccaacaagctcacctatctcgacggcaatcgactccggttcaagaccgagccacccgagctcgtgcagatcaacgacattcgcggctacgaggacatcgatgcgctgcgcggccgcctgcgacagctgttcgacacctaccgtgattcgctgtatgaggaccgccgccatgtgctcgaacagtaccattatcaggacacagcgcgcaaggtggtcggcgtcggttccgttggcacccgctgctggatcagcgcgttcataggccgtgacatagacgacccgctcattctgcaaatgaaggaggcggtggccagcgtgctggccaaatacgtgggccactcaccctacagcacgcacggtgagcgcgtgatccaaggtcagaagctcgtgcagtccaccgccgacattctgctcgggtggtcgcggttcgtggccaacgatggtctgccgcgcgactattacgtgcgacagctgtggaatggcaagggttccattgatcttgacacgctgcatgcggattcgttgagcaatctgggctcgctgtgtgcgtggtgtctcgcccatgcgcatgcgcgcagcggcgacagcgtggcgatcagcgggtatttgggcgacagcgacgaattcgagacggcgatgatgagcttctgcgattcatacgccgaccagaacgaagacgatttcgagctgttcacccaactcatcgcatccggtgagctcccttgcgcatagcccgttattcggtgacgcaaacaactcgaatgcatgcatatgatcatatggtgcgtcaatggggatccggcagaaaatgtccccattgacgcaccattcaattgacgcactgtgcaatatcacgcattggctacagcaagtgcctcttcgagcgtgaaggcgcccgcgtagaggctcttgcccagaatcgcggaatcgacgccaagcggcagcagctccttgatggcacgcagatcgtcgagcttcgagatgccaccggaggcggtcactctggcatcggtgcgctcggccacttcacgcagcagatcgatgttcggcccgctcatcatgccatcgcgggtcacgtcggtgaccacgtagcgtgagcagcccgcgtcgtcgaggaaccgcatcgtctcgaacaggccaccgccctccttcacccaaccgcgggcggcaagcgtatgtccacgcacatcgaggccaacggccaccttgtcaccatatttgtcaatcacacgggccgtccactccggattctccagtgcggcggtgccgatgttcacacgtgcggcgccggcgtcgagcgcggcatccagggaggcatcgtcacgcacgccgcccgacatctcgatgttcaccttgtctccgagctgcctgacgatctcacgcaattgggcgcggttgtcccccgtgccgaaggcggcgtcgagatcgaccaagtggatccactgcgccccggcgtccacccacgtgcgtgcggcgtcgagcggcgagccatagtccgtctccgaaccggactcaccttgacgtaaacggacggccttgccgtcacggacgtcaacggccggcaacaaagtcagtgacatgttctactccaatctggaatcttaaaatacggcaaataacaacataactagagtacggcggcccagttcgcgagcagtctggcacctgcctgcgcggacttctccgggtggaactgcgtggcgaacagaggcccgcgctcatagctggccacgaaatggctgcggctgtaatcgcagaacgccactttctgctcggcgtcgccgaggtcgatgtcgaactgcgtcaaatccgcgggcgccgcggtgaaagcggcgtaggagtgcacgaaatagaaccgttcgccctccacgccattgagcagcacggagccttcgggggcatcgacggtatcccagcctatgtggggcaccacgtcggcatcgagtctgctcacctcgccgtcaatgagctgcagcccaggcgtgtcaaggtcatgctcggtgccacgggtgaacatgatctgctcacccacgcacacgccgagcacagggcgccccgcacgcagacggtcgtagatcacgttgtcgccattcaccttgcgcagtccctgcatgcaggcaccgaatgcgcccacgcccggtacgacgagaccgtcggcctccagggccttgcggtaatcggaggtgagcgtgacgtcaaggtcctgattggcgagtgcgcgcatcatggagcgcacattgccgaacccataatcaaatacgactacagatttcataatctcactttcttcctgtgccccgtgcattcagtcgatcgacgagccgtcacgcccgaagttcgtatgctcggcgatgattttcaatgcatggtcgtgatccagatccgcggaatcgacaatcctcacaccctgctgcgcgagcgcatcgaccgtggtgagtccgagcatgagatcctccacgaaatgcgcgagcgtctccagcacgaacggcggcggcagttccgcatcctcggcggtgccgttcgcatagggaacggcggtcatcttgtcggcgcgatccacgagcaacagcacgctcagccccgccaccacttcggtgaggtccttcgcggccgcctcgggaccgtccccgttgagattgcgcagcactgccaccgcaccctcacgcgaatcgatgcattgcgcggtgatgtcggcgagcgagcagaaggcggcgagcaaatcggccgaggtgaggcgcgtgactagaatcgcacgcttcgccttgttgccgagaatcccctcgagttcgtcgtcgaagcctatctcggcgttcgcgttcatgatctgcgagaactcgtcggacacgtcttcgggagcattgccgtcttccgattccccggtcgcggattccccggcatcgtcggtgctcgcattctgctcgagattcgcaagctcctggttgaggctctccatctcacgtgcgagatccggatcgctttcgaaggcccagaacgcgtcgttttcgtcgccggggttatcgggattgttgggatttcgcttgtcgtcgtctgacatcacaacgcgcccttcgtgctcgggatcagcccctgaatacggggatcgggttctatggcgaagcgcaatgcgcgggcgagcgccttgaactccgcctccgcaatgtggtgtgggtcacggccggcaatgagatgcatgtgcaggcagatctgcgcgtggaaggcgatcgattccatcacatggcgtacaagcgagccggtgaagtggccgccgatcattgcgtactggaagccttcgggttcgcccgagcacacgcagtatgggcggccggagacgtcgacgacggctttggcgagcgcctcgtcgagcggaacggtggcatcggcgaagcggcggatgccgcgcttgtcgccgagggcctggcgcaatgcctccccgaatacgatcgccgtgtcctccacggtatggtgggcatcgatatcggtgtcgccgctcgccacgatgttgagatcgatgagcgaatgcttgcccagtgcagtcatcatgtgattgtagaacggcacagtcgtttcgatgttcgtcttgccggtgccgtcaaggttgagttcgaggtcgatgctggattcgctggtctggcgaacaatgtgcgcggtgcgtgccatgtgtctccatgtctcctttgcaggtatacgtatgtctgcggcctaggcgttctcgacggcgcgcatcgattcgacgagcgcctcgcggaatcggcgcatctcctcgtcagtgcccatacacacacgcagccagccttccggccccaccacgcgaatgagcacgccacgctggagcatttggtcgaagatggctccgcgatcatcgaaatggccgccgaacagcaggaaattcgactgcgagggggcgacttcgagtggctggcccttataggtctgttccttgagccaagcggcggtctgctcgcgaatctcgcgcaggtggtccacctggctcagctgttccttcctatggtcgaaggccgccagcgccaccgcctgcgtcacggcggacagatggtatggcatgcgcacgatgcgcaggcagtccacaataccctcgctggccgccagatagcccactcgggctcccgcaaacgcgaatgccttgctcatggtgcggctcacggccagattgtcgtagtcgttgatgagcgtcgtggccgacggcgtgcccgggttgcggaattcaatgtaggcctcatccacaaccacgatcgggtgcaccccatcgtgtgcaccagcgacctgagcactctggcaatgttcgagaatgcgcttgagatcggtcataggcagttcggtgccggtcggattgttcgggctggtgagcaccaccatggccggctggatcgcatcgatgtcatcgatggtatggtccacatcaagggtgaagtccggcttgcggtgcgtggtgtaccaactcgtgaacgtgtcgcgtgcatactcggggtacatcgaataggccgggtcacagcccagtgcggcacggccagggcctccgaaagcctggaacagctggagcatgatctcgttggagccgttggcgccccacacctgttccacggtgagctgcgcccccgattcctccttgaggtacctgacgaaggcctcgcgcagttcgatgtgctcgcggtccggatagcggttgagggtaggcgccacctgcttgacgtgctccactatgctgcgaaccacggcgtgatccggcggatacgggttctcattgacgttcaggcacaccggaacgtcgagctgcggggcgccgtagggcacctcgccaatgaggtcgttacgcagtggcagatccgccggaatcatcgcttcgctcatcgtaatcctgcttcttcttcctgttcggtaatggtttccttgttgtacggatcgtcaatgaagcgcgtcagcacgctctcgccgtgcgccgggaggtcttccgagacggcgagggcattcaccctggcggcgagctccttcagtccctgctcgtcgtattcgatgacctccaccggcttcatgaacgtgtgcacaccgagaccggcggcgaatcgtgcggtgcccgaggtgggcagcacatggttcgagcccgacatgtagtcgcccagcggcaccggggaatagttgccgcggaagatggcccccgcgttgcggatcttcgcgatcacggcatccgggtctgcggtctgcacttcaagatgttcggcggcgtaggcgttcgccgcgtcgatcgactgctcgatgccgtcggtgagaatgatgccggactgcttgccggagaggctggtggccacacgttcggagtgctcggtgcgcggtacgcgcttgttgagctcggcctgcaccgcctcggccaactgatcgtcgtcggtgatgagcaccgatccggcgagttcatcgtgctcggcctgaccaatgaggtcggcggcgacatatgccgggttcgaggtcttgtcggcgatgatggcgatctcggtggggccggcgaccgcgtcgatgcccacaatgcccgaaacgagacgcttggccgtggccacgaagatgttgcccggaccagtgatcttgtccaccggctcgcacagcaccggggagaccggattgtcgaggtcggtggcgccataggcgaacatcgcgatggcctgtgcaccaccgacggcgtagacctcgtccacaccgagaatggcacaggtggccagaatcgtcttgttcggccaaccctgcgcattgtcacggcttggcggcgtggcgatggcgaggctttcgacaccggcggcctgtgccggcaccacgttcatgatcacggaactcgggtacacggccttgccgccgggcacgtacagacccacacgctggatcgggatccagcgctcactgacgcgcgcaccctcagccaaatcggtatggaagtcctctgggacctgcgatttcgcgactgcgcgggcacggcgcacggattcctcaatcgctgcgcgcacttccgggtcgaggcacgccacggcggcatccatgacgtcggtgggtacacggaacgacttggggacgatgtggtcgaatttctcggcatattcacgcaacgctgcggcgccgttctccctcacgttgtcgagaatcggctgcacgatctcgctcgcttcgtcggttcccatctcagctcgtggcatcgcgtcaagcatctcggcgcgtgtcagttccttgccgcgcaaatcaatgatgcgcatatagttatcttggctcataagccactatggtaccaagcgcctgtcacgagaaggaaaacgagggcatcgggtcttttgcatcgtgagattgcccgctggcgcgccccgacgagttccgtaggttcgcgttaattcagcaaatccacgtaatcggggacgcatcccgtgtgaaattagttccagattacgcaaaacaatgacaaagatcagacgcggaaatgagagatggcaggcatccggtttgtgcgaacggagacggcatgccatcgcatgccgtctccgttcgcacaaaccgccgttcagatcataggcagtgcgttggcgccaaaaagaaccttgatgtcggcgaacaggccggtctcacgacgcacacggaagcgatcgccgagggtcatgagggtcacgccgccattgtcgtcgacgatggcaagcctgacctcgcaggcaccgggatgattggagaggatctgcgagaactgttcgagccgttgcatatcgagggcgtgcgcaggcagctggacgaaaacaggacggtcctcaccggcttcgatgacgggcaccatgaggtcggtggcgcgcaacgaaatcgtctcgtcacgtgcctcgaccatgccacgcacctgcacgatcgtgtcgatggcgagttccgccgcgtgcgcctcgtacaccttgccgaacagcaggcattggatggagctctccatgtcttcaatcgtcacgatcgcccatcggttgcctttcttggagacgcgtgagtcgacgttggtgatgagcccggcgaccatgacctgactgcgctcgggcatcgtgggagcacggtcgatcagttgcgcgatggacatgtcacgcaggctggcgagcacggactgcatgcctgaaagcgggtggtcggacacatacaggcccagcatttcgcgttcgaagttgagcttggtcttcttgtcccactcctccacgtcaggtacgctgatcgacacgtcgccaagcgcttcggcctcgccatcgtcggcaccggcgtcgaggtcggcgaagaggtcgaactgcccagtggcctgcttgcgtttgaggtcggtgaccgagtcgatcgcggcctcgtgaatctggtagagggcacgccggttggggtcgatcgagtcgaaggcacccgccttgatcaacgattcgaccaaccgcctattgagtgcggtcagaggcacacggcgaatgaagtccatgaagttgacgtacctgccgtggctgccctgacgctcggcaatgatgtcggcgactgccttttcacccacgttcctgatggcaccgagtccgaaacgcaccacatcaccgacggcggagtaggcgtacacggattcgttgacatccggcgagagtaccttgatgcccatgcggcgcgcctcgcctaggtacagggcggtcttgtccttgttcgtggaggcgccttgcaacagggcggccatgaactcggccggatagtgcgtcttcaaataggcggtccaatacgagatgagcccgtaggcggcggaatgcgccttgttgaacgcatagcccgagaacggcacgagcacgtcccacaccgcctgcgccgcctcgcgggaatagccgtgctccttcatgccttcgaagaacggcacctgttccttggccagcacctcgggcttcttcttgcccatcgcgcgcctgagcacgtcggccttgcccagcgaatagccggccagaatacgggcggcggattgcacctgttcttggtagatgatcaggccgtaggtctcgtcgagcacctccttgagcggctcggcaagctccggatggatcggctcgatcttctgcaacccgttcttgcgtttcgcgtagttcgtatgcgagtccatgctcatcgggcccggacggtagagggcgatcaatgccgagatgtcgttgaagttatctggcttcagctgcttgagcagcgcacgcatgccgtcggaatcgagctggaacacacccagcgtgtcgccgcgcgacagcagttcgtatgtctccttgtcgtcgagcggaatcttcgtatggtcaatcggttccttgccgttggcctcgatgttcctgagcgtgtcaccgatcaccgtcaagttggacagacccaggaagtccatcttcaccagacccaatgtctcacacgtgtggtattcgaatgtcgtcgtcaccgtgccatccgtgcgctccagcagcggcgacgtgtcagtgatcggctccgagcccatgatcgtggcgcatgcgtgcacacccgtctggcgaatcaggccctcgatgcccatcgcctcgtcggtgattcgcttggcatcgggattcgactcatacaattcgcggtattcacgcgcctccgcatagcgtttcgcacctggatcgaaaatgtcgtgcagcggcacgtccttgccacccgttgccgccggcggcaacgccttggtaaccaactcgcccatcgagaactcgtagcccatgatgcgcgctgaatccttgagcgcctgcttcgtcttgatcgtgccgtagatcacgcattgcgccaccttgtcgtgcccgtatttgtcgccgcagtactcgatcaccttcagacggccctccgggtcgaagtccacgtcgatatccggcagcgacacgcgctccgggttcaggaaccgttcgaagatcagaccatgctccaggggatcgagctcggtgatgcccattgcataggcgaccatcgatcctgccgcggagccacggcccggccccaccatgatcccatggtctttggcccattggatgtaatcagccaccaccaggaagtagcctgggaattgcatctggcagatcacaccgcactcgtaatccgcctgcgccagcacatgcgccggcacattgccctcgtaccgccgttcgaggccctcctccactttcttcaggaacagcgaggtctcgtcccaaccctccgggcatgggaacttgggcatgaacgcgccgtcctcgtggtcgtcgaacatcacattgcaacgttccgccacctcgatcgtattgtcgcacgcctcgggcaggtcgcggaacagctcgcgcatctgctgcgcggaacgcatgtaatacccttctccatcgaacttgaaccggtccggatcatccaggtgcgagcctgaattgatgcacagcatcgcgtcctgcgcgccagcatcctcctcgtggacgtaatgcgaatcgttcgtggccagcagcggcgcaccgagcttcttcgcgatctcaagcaggtccttcgtcaccttgcgctcgatctcgagattatggtccatcagctcaatgaagaaattgtctttgccatagatgtcctgcaactcacccgccgcacgcaaggcctcatcgaactgaccgaggcgcaaacgggtctgcacaatgcctgacgggcatcccgaaccgcagatcacgcctttgctgtaggtggagagcacctccttgtccatacgcggatagcgcatcacacgtccttcgagattcgccaccgaagaggccctgatcaggttcctcaatccttcgtcgtcctcggcccacagcgtcaaatgcgtgatcaggcctccaccggacacatcatcacgccgttgcgcctccgtgccccaatgcacgcgcgatttgtcttgcctcgccgtctccggcgtcacataagcctcgatgccgatgatcggcttgacatcctgcttcaccgcctcggtgtacatctcatacgcgccatgcatgttgccatggtccgtgatgcccacggcacccattcccaattccttcgtgtacttcaccagatcgggaatcttcgatgcaccatcaagcaacgaataatgcgtatggttgtgcaactgcacgaaatcagcggaattggtcatagtgttctaatgtaccttgaaatccgcttgctgtacagagcgcgaaccggggtgccccgcaacccttcgaacacgccatgtccgtttcgacacgcggcatttccagcgcatcaatcgcttcatatggaaacagcgtcgcctcgtcgctagagtgttggcaacattgccgagtaagtcgacgcgagggaaggaaggctgcctatgacggcatcgaagccggcccgcggcaggcgcatcgccgtatatgtggcgctcattccactctgcgccctgcttgcccttcccggagccatcggcatggtgcaggccattcgcattctgcttggctgcgatcatgcggccggctattccaccggggtgcgcgagctggaggcgtggaccagtctgttgttcaccacgccgttggccgttatgccgacctgcgcgatgatcatattcgtggtattggcgattacggaagccagtcgcgggaaatcaccgccatcgtcaccctcgcgacgactctaaacgctggtgctcccgttgggcgaagcgctcacgctccgtctccagcgcatgctgcagatcggtggggtaccgcgaggtgaccacggtgttgatgtgcgtgcgcggatgccggaactccagctccatggcgtgcagccattgacgttcgagccccagtgcctgagacagacggggattggccccgtacatcgggtctcctacaagagggtgcccgatggacgagaaatgcacgcggatctggtgggtgcgtccggtctcgagattgattgacgcgagtgtggcctcgccgaagcgttccatcacgtcccaatgggtgacggcctccttgcccgcgggcgtgaccgtgaagcggaaatcggagacctttgcccgcccgatcggagcttcgatggtggccttgtcttccttgagattgccttgcacgagcgcatggtaggtcttcttcacctcatgctcggagaattgcctgcgcatctccttgtaggcgaggtcggatttgcatacgagcatgagccctgaggtgcccacatcaagccgcgagacaatgccctgccgtcccgcagcccccatcgaggtgatgtgcacaccgcgctggatcaacgaacccagcactgttggcccggtccagccgaccgaggcatgcgccgccacaccgaccggtttatccactaccacgatgtcgtcgtcctcataggcaatcgtcatttcgttcgaaacgggttcgggttcccgtctctcttctcgcacatcaatctcaacggtgtcgcctgcttgcaatgtggcggatttatggatatcacgcccgatcacacgtgcctgcccggtttcgatgagttcagtggccttggcccgtgagatgcccatcatcttggccacagccacatcgaaccgcttcccgatcagtgcatcgggcgccggaatgatcgtgctcattgagctccttccatatgcctagttatcggaatgtccggcagccgctgtatcagccggctgtcgctcgtcgctccccctatagggcactccacacagaatgagcacgatgatgcctattcccgcgatcatgaggaagatgtcggccacattgcccactgaccaaccgtaattgaggaaatcgacgaccttgccattgaggaatccttgggcatatgccacgcgatcgatcaggttccccaacgccccggcgaaggcgagtgccaggaacacggtccaggccatcgatgtggtgcgccaggccatccagacaagcacacagcatgcgacaatggcgaagaggctgatcacccaggtcgagttggcccccatgcccagcgaggccccgggattatggaccaacgtcaggtgcaggaaccgtgggatcacctgaatgtaatcggtctcggtcaggtaggtctgcgccaggtatttgctaagctggtctgccccaagggcgacgatggcgatacatgcaaagacggccacgcgtacacgcggccgtcttggtttcgaattcaacattggctaatggtatcagttggccttgtcgatgtccttgtagttgttcgtgtcggagacctgtgcctgcagctggccgaggaactcggtgaggcgtgcacggtattcggtctcgaaggtcttgaggccctgaatgttgccttcgatcaccttcgactgggtctcgaggttctcacgcacctgctgggcgtagtcgtcggcagcggtgcgggtcttcgccgagtagtcgtcggcacgcttcttggcttcggcctcgaatgcgttgatctcgtcgtggcgttcgaccacgtactggtcggcctcgctcttcttctgctgggcgtaggtgttgccctcgtcctgcttcttctgagcgtattcgtctgcctcatgggccttcgagtcggcataggtgtcggcctcgttggtcttggcggcggcgtagttgttcgcctctgcgatcttctgatccgcgtaggtgttcgcctcattggtcttgtcgaccacgtactgatccgcctcggcgtgcttgttcttcatgtatgtgtcggcatcttcatgcgtcttggcgctgtacgaatcggcatcgtcacgagtcttcgcactgtaggcatcggcagcctcgcgggtgcgggcattgtaatcgtcggcctcggaacgagtgcggttcgaatagtcgttggccttggagatgagctcctcatacttgcgctgggcctgctcggtgatctccttggcggtcgccttgcccttgtcgacgtactggtcgtgcagctgcatcgcgagggtgagcatcgcggtggcgcgctccggctcgctgttggcggccgcagcagcgctcttgatcttctgcaggctgcccgtctcagtgttcggttcgaccttggccacctgatcgcgcagctgttcctcacgctgcttcgattcctcgagttgcttggtgaggtccttgacctgggcttcggcctgctgggcgcgcatcgtctgctcgtgggcagcggagagctcatgacgcagattctcgctgtcggcgcggaactgatcgcgctggcgggtaatctcctgcagctccttggcgagatccggctgatcggagttctgcgccgcctgtgcggtgagctgatcgacctgcgcggaaaggcgttcaatctggttcttcagctgttcattctgagtggaaagcgcctgattgttcgactcggcttccttgagctgcgcctgtgcagcctgtgcggcctgattcgcctgggcgatctgcgccgtcgcctgttcgcctgcaccttgcgcggcggcggccttgagcgactggttctcctgctgcagggactgcacctgtgcagtcaaatcggaaatcttcgtgttcagcgcggagacatcagggccgagtgcctgcgtggactgaccacctgcaacagcctgcttgcccaaagcctccacggtttcggttacctgatcgaggaagtcatcgacctcgtcgacatcgtacccttccttgaagcgcaccgtttggaaggtgtgctcccgaatatcctttggcgtcaaaagagccattatcttaccacctcgctttgggatagacccagcttagttgaccttattttttgatgctatcacgacacctgcgcaagcacaccgcatgggcggcttttttcacatgaccatcggactttttccatcggtcagatcagtatgcgcaagatcaccaatacgaaatacaacaccagaaaactcacatcgaagtaaacgcgccccaggggaatcggcttgatgtatcgtctcaggaagcgcagtggtggctcggtgagctggtagatgatgcgcagcagggtcgccacaaaaccggtcggccgccatcgcggagccagcaccagcacccaatcgaagatcatgcgggcgaacagcaccgcgatgtaggcctcgatgagcaggtcgacaatatggaagaagaagccgaataacgtcgaaagcatgctcccagcctatcgaatgactaggaacatgcttcctcgaacagcaaatgacgtgaatgtgggggccgctgccccgcctcatcagttctcgaacaggttgtctgacatacccgattcagtgtcctccgcgacaatgtccacacgagcgggactcagcaggaacacacgctcggtcacgcgttcgatggagccggagatgccgaacaccacgccggacgagaaatcgatgatgcggtaagcctgtgactgcgagacatcggtgagattgagcaccaccggaatgccgtctcgcagtgcgcgaccgaccagttgcgcatcttcgtagctctgcgggtgaatggtcgtgatccgattgatgttcgcatggaacggggccaccgacttacgctggctcgtggaaggctgcgtggacgcggccgggatgggcgtgacggaacgatcggtgtcgaatgacgactccggctcctcgtcaatgacctcgtcatcttcgtcttccggcacgacgtcggacattcccagataagacatggtcctcttcatgaatccggccattcgcgtttccttctttgctgtcctgtttcaggttgactctttgggttctacaggtattgtaattcagaccgtgccgtaagcggatcgactactgcaggaactccggaatgtcgaggtcacccagatcaccaagcgccgtatacggatagctgctggtgtcggacgaggcatcgtattcggagcgttgcttcggcgtcggctgctgggccacgatcttctcatccgtcttcttctcctcttcgaacaccggaccggtggagggaatgggagacgtgaggatggtgggctgcccggaagccgtggcggtcttggtcaccggtttgacggtgcgctgaggcgccgaggcggcggcctgggcgtcctcattggcctgagcgagcttcttcttgtcgttgaagccggcggcaatcacggtgacgcgcatctcatcgccataggcatcgtcgagtgcgagaccaaagataatctgcgcctccggatgtgcggcctcgcgaacgaaaccgacggcctgattcacctcggcgagcttcaggtcgttcgaagccgcgatgttaatgagcacgccgctggcgccgtcgatgctctcctcgagcaatggcgagctgatggcgatctctgcggcctgcgctgcacgatcctcgccccgtgcggcgccgatgccgaagagtgcagtgccggagttctgcaggatcgacgtgatatcggagaaatcgacgtgaatgtacggattgatcgtgagcaggtccgtgatgccctgaacaccagcgagcagagcggtgtcggccgtgcggaacgcatccacgatgccgatggagctgtcgtcgagttcaagaagtcggtcgttcggaatgacgatgagcgcgtcgacctcttcgcgcagattgtcgatgcccagcgctgccgaggcggcacgctgcgggccttcgaaggagaacggacgagtgacgactgcaatggtgagcgcgccctgctggcgtgctgcgcgggcgaccagtgggcttgcaccggtgccggtgccaccgccctcaccgcaggtgacgaacaccatgtcggcgcccttgacggcctcttcgatctcggactggtgatcctgggcggccttcgcgcccttctccggatccgcccccgcgccgagccctcggctcgaggcgtcgctcagcgagatcttgacatcggcgtcggaacgcagcaaatctttcgcatccgtgttgattgccacgaattccacattctgcagaccctcggcaatcattcggttgactgcattgccacctgcgccaccgacaccaacgaccttgatgatcgtggtgtcgttgaaattgtcggtctgggcgatctcgctcacgttagtctcctgtcactcacggttgtacacaactgtaccgcagatgggtgagaaaacaggcctccctccactggccaaggccaatccgctcaccctcctctttacattcctcgtagacaccgtagacccgatttccgaaagttttcttaaaacgtgtcgctcagtagctcgcatccatcgggtcgtcgccgaacagtcgctcgcgctcctcgtgggtcgtggtccgcgaatcgagccaaccatatggcaaatgcaccttcttcgcaaagcgaacacgacccctcggctggtccaccacccgttcaggatactcgatgttcgggtcaagcgcgtccacctgctcacgaacatccttcaaactctcgcattccatgaacgcgcgcctggtggagccccccaccgggaaccctttcaggtaccatgcgacatgcttacgcaggtcgtgcacagccatccgctcgtcaccatcgtagaactcggtgagcagctcggcatggcgcatgatgatgcgccccacctcgccgagggtggggttgatacgcacgtcgctgccggcgaaggcgttgcctatattgccgaagagccatggccgcccttggcacccgcgaccgatcgccactccggcacacccggtttcgttcaccatcgcgatggcgtcctcggcaccccagatgtcgccgttgccgaacaccggtatgtcgagcgtgctcacgagctcaccgatccggcaccaatccgaatgaccgccatagtattcggcagtggtgcgggcatgcagggtcactgcgctgcacccctcctcctgagctatgcgcccggcttcgaggaaggtctcatgctcatggtccagccccacgcggatcttcgcggtcaccggaatgttcgccggctcgcacaccgcaactacgcgctggacaatctcggtgaacagatccgttttccatggcaaggccgatcctccaccacgccgggtgactttgggaaccgggcacccgaaattgagatcgagatgatccatcatgccgttgtccaccaggaaccgcgccgcttgttccataatcgacgggttcacgccatacagctgcagcgatctgatgcgctcgctcggtgcgaacctgcacaacctgagcgccttcggattgcgctcgaccagcgcgcgtgcagtgaccatctcggccacgtaaaggccgtcgggcccatattcctcgcacagcacacggaacggccagttcgtcacacctgccatcggggagagcatgaccggagtgttcaccatgacatcgccgagcctgatcggtgccaacggaccggccaaaaccggttcaagccgtgcaccggcatctgcgcaatccttggcatctgggcttgcctcgcgttgccgggatgtgttcagtatcgtctcctgctcgctcatatcccctcgttcatgtgtccgaattgtacagagtatcgtatgaattattcgcacgctcgcctcgtacgcaaaatcgcctgcgtcccgcaatctcaggcatacggggcgcaggcgattgatgcatggcagatcagtacaaaccgccggcctcggcgatatgcacggtctcgggccattcggcgccacccatcgacaccggtttgagcggcacacgtgtacgtttgtcgttgatgcgcttggccacgtagtcggcaacctgggtgagcgccacgcgctcctgctgcatcgtgtcacgctcgcgaatcgtcacggcctggtcatcaagagtgtcgaagtcgacggtgatgcacagcggggtgccgatctcgtcctgtcgacgatagcggcggccgatcgcaccggattcgtcgtagtcgatcatccagtcattgagacgcagatcctgcgcgaggtcctgggccaccgactgcagttccggcttcttgctcaacggtagcaccgcggccttgacgggagcgagacgcgggtcgagacgcagcaccgtgcgcttgtctacgccgcccttggtgttcggggcctcgtcaacgtcgtaggcatccacaaggaaggccatgagcgaacgcgacagaccggctgcaggctcgatgacgtacggaatgtacttctcgccggtggcctggttgaagtagctcaggtcctcgccggaatgcttggcatgggcgccgagatcgaaatcggtacggttggccacgccctcgagctcaccccaatcggagccctggaagccgaagcggtattcgatgtcgacggtgcgcttcgaatagtgtgcgagcttttccttcggatgctcgtaatggcgcagattctcggggttcacaccgaggtcgatgtaccactgtgtgcgggcgttgatccagtactgatgccagtcctcatcggtgcccggctcaacgaagaactccatctccatctgctcgaactcgcgggtacggaagatgaagttgcctggcgtgatctcgttgcggaagctcttgccggtgttggcgatgccgaacggcggcttggagcgcgacgaggtcatcacgttcttgaagtccacgaagatgccctgtgccgtctccggtcgcagataatggaggctgttctcatcttccacaggaccgaggtgcgtacgcagcatcatgttgaagtcacggggttcggtccaattgccgcgggtgccgcagtccgggcacacgatgtccttgaggccattcgggggcagctggtcgttgtgcttctcggcatacgactcctcgagcttgtcggcgcgatgacgcttgtggcaggtgaggcattcgataagtggatcgttgaacaccgacacgtggccggaggcgacccacacctcggacggcaggatgatcgacgtgtcgacgcccacgacatctggtcgggtgacgaccatcgagcgccaccattcgcgcttgatgttgtctttgagcgccacgccgagcggcccgtagtcccacgcagagcgggtgccaccgtagatctcgccggccgggaacacgaagccgcgacgcttggcgagggagacaacttcatcgattttggaattagccacaatgcaccttctggtttgaacggtttggggtcttatacaaggcttcaccctaccgttggcggctgacacgcagggagcccgttccggtgcccatgtggggtgatgacacgcatgagcacagcaggcgtcgagagtgttcaatacgtttggaatacacatgtcaggggagctgatagagctgagagtggcttcgcgcctaacccttcgaacctgttggctagcaccagagtagggagtacagatgaccacagcgtcgaccacgccgaattccgacacatccaatctacacgaggtcgcaccagacgaccccattcgtgagcgtatacgccaggcggcgcagaatgttcgcgagcagaccccgcttgcgcagtcattcaccaatttcgtcaccattaatctggtggccaatgcgcagctcgccgcggggggcaccgccgccatgagcttccttcccaacgatgtgacctcgttggcctcttcgtgcggtgccacatacatcaacgtgggcacgctgctgccgttctaccgcgatgcactgcaggagatctcggagcatctgagccgccatggctgcaagtgggtgctcgacccggtggcagccggcgttggcgtcgcgcgcaccgagatcctcaaggggttcaaggattaccctcccaccgtcatccgcgccaacgcatcggaggcactggtgttgcacgacatgtggcaactgggcgatgcagccggaacggatgagcacaatgggcccgcaggcgtggaggccgccgacagtgtggatgccgccatcaccgcggccaccgatctggcggcgtatctggcgctccactcccccacccacacgggggccgtcgcggtctccggcgaggtcgatctcgtcaccgacggacgactcgtctaccgacttcccggtggaagcgcgatgatgacgaagatcaccggtgccgggtgctcgcttgggggtgtcacggccacctatcttgcagtggccgatccactggtggcatcactggccgcctcgatgctctacaacgtatcttccggagccgccgaacgagcatcgcatgggccgggatcgttccaaaccgcgttcctcgacgctctgtggaacgttacgccggaggaaatcgcctccgcaccgctctatttggcctagaatctgccatggcacggcatgccggcacacaacaaacgaatcaggtgacacaatgaactcgttcccatacccatccatgcgcgaccgtttcgacctgcgcttctatttcgtggtcggccccgacgattgcggcaaccggccgattctcgacgtcgtggccaaggccctcgacggaggcgccagtttcatccagctgcgcgccaaaacccaggatgtcgccgagatcgtctccctggcgaacgacatcgccgaagagatcgcaggccatcacgtggagcactcggtggcctttgtggtcgacgaccgggtcgatgccgcgctcgaggcccgtgccaagggcatcaaggtcgacggggtgcacataggtcaggacgacctcgatccagtggtggcacgaaagctgcttggacctgacgcgatcattggactgtcggcgaaaaccgtcgacgaagtgcgcgaagccaaccatctgcccgaaggcaccatcgactacataggagccggcccactgcacatgacggccacgaagcccgagagcatgatcgtcgacgaaaatggcgatatcaccacgctgaacgtctcctccatcgacgaaatgcgcacgatgagcaagtatccgctcatcgtgggcggtggcgtgaaagccgacgacattcccatgctcgccaagacgaaggccgacggctggttcgtcgtatccgccattgccggcgccaccgacccggagcaggccactcgccgtctggtcgatgactggaccgccattcgcggcgacgagaagccccggtacaccggacgcaagcctgctgcaaccaagctgccggccgtgctcacgatcgccacaaccgactcctccggcggtgccggcattcccgccgacctcaagacgatgctcgccaatgatgtattcggcgaatgcgtggtggcgggcatcacggcgcagaacacgaccggcgtgcaggccatcgccgccgtggaccccagcatcgtgggcgcccagatcgattcggttttcgacgatattcgacccaccgccgtgaagatcggcgtcatcgtgggcgttgaatctgtgaaaaccgtcgcccgcaaactcagggaccaccaggccacgaacatcgtggtcgacccggtcatggtggccacaagtgggtcgagtcttgccgcggacgacacaatcgccgaggaaatcagcagtctcttcccgattgccacggtgatcaccccgaatattcctgaggcacaggtgctggcccagatgccgatcggcaaccaggccgacatggagaccgcggccgtccaactcgccaaggactatggcacctgcgtgctggtcaaaggcggccatggcgtgaaggacgccgacgacgtgctcgcattcccgaccggtgccgtcacgtggttcgagggggaacgcatcgccaacgacaacacgcacggcaccggctgcacgctgtcgtccgcaattgcctcgtatctcgcccaaggcgaggacctcgaagacgccgtacgcgacgccaaggcatacctgagcggagctctgcgcgcgaatcttaacctcggcaaaggtcacggtccgatggaccatgcctgggcgatgcactgagcagaaggcaatctgaaattccatagctgtgtggctgagcgatgaacagacatgcccggtcgcacgcctgcgacaaaggagaagacacatgaacagccctgatcgcaatgcggtgcggcaggaagtgcccgtggacgagcacggcaaaccgatcatcaacacggtggcggcagtggcgatcgcccccagcggtgtcggcgccgagctgagcgaatacgtggcggaagcggtggaggtgatccgcgaatccggattgccgaacgagacgaacgccatgttcacgaacatcgagggaaaccttgacgatgtgctcaaagcggtgcgcgacgccacggtgaaactcgccgaacagggataccgcaccggcgtgacgctcaagctcgacattcgcccgggcttctcagggcagatcagcgaaaagcagcagctcgtggacgagatactcaccaagcggtaagcggcacggaatatgtgggtgtgccgtcggtatgtcatgtgcatattcggcataggacgtataaggtggaatcatgacgacgatgaaggaaatcgcacaagcggccggagtctccgtctcctcggtctcgctcgtgctcaatgggcgtgattcggggcgcatcaatccgcagcttgcgaaccgcatacgcgaaaccgcagagcgaatggggtaccagcccaatgtgctggcccgctccctacgcaccaaccggacgtatatgatcgggttcatcagcgtcgaagtggccaccacgccatatgcgggcggtatgatccaaggtgcacaggacgccttgagctcgcttggctacatgctcctcaccgtgaacggagacaccgaacaggccctggaaagcgagatccgcgctctgaaacgctacggtgtggatggcttcctgtattccgcgatgtcgaaccgcgtgatgacggtgcccaaatcactcgccaagttccctctggtgctcgtcgacgccgcagaggagaccaatcgcttcccgtccatcgaaccggacgagttccgcatcggctatgacgccaccaccagactcatcgaagccggatgctcccgcatagcgtatgtgggatgcgccgaacccatggtggcacagaccggcaggctcgccggttaccgacaggccctgatggaccacggcaggggcttcgacgaacgactgcaatgcgacgtgctcaacaacgggccggcactacgtgccgtggaagcgttattcgacaccgagcagcccaacggattcttctgcttcaacgacgcacgcgcctggtatgtatacgagacggcggcacgacatggactggccgtcggacgcgacatctcggtggtcggcgtggacaaccatcgcgtatttgccgagacactcgagccgcaactcaccaccatcgaactgccccactacgagatgggctactgggccgcgaacaagctcgtgtcgatgatcgagaaccgcccgctcaatgaaggcgattggccccatacgaccgcggtgatgcctctgcttgacacgccatcgccggtgaaggtgcactgcacgctgatcgagaagggatcggtgcgcgacacgccgacgaccgcgtgacgcatggtcactgcggcagcaaagaattcgtcaaacgattgacattaaggcttcaggaaatatggtggttttatggagaagaagtcaatcgtttgatgtcaatcgatttacactctattctgagaacatatggaacaccacaactgacacagacgacgcgaatggtgctcccctagcagacccatcgaggcctgccccctcctgcgcacaacacggacacacggtgcacagaccggagcaatgcgcgggagccgtcatatacaacgcagcttaggctcagacaacgaggttcacatcatggcaacaaccacgaaggtgtggaggaacccctcctacctgcaaagctcaaccggcatcttcctgttcttctgctcctggggcatctggtggtcgttcttccagcgctggctcaactcgatgggactcaacggcgcggaagtgggcacgatctattcgatcaactcgctggccacgctcatcctcatgttcgggtacggcctcatccaggacaatctcggactcaagcgccgtcttgtgctcgtcatctcggcgatcgccgcactcgtcggacccttcgtgcagttcgtgtacgcgccgctgatgaggacgaacatgatggccgccgcactcgtgggctccgtcgttctctccgcgggcttcatggcaggctgctcgctcatcgaggccgtgaccgaacggtacagccgccgtttcaacttcgagtacggccaatcccgcgcatggggttccttcggctatgccattgtggcgcttgtcgccggcttcgtgttcaacatcaacccgatgatcaacttctggctcggctccgcattcggcgtgggcatgctcatcgtgtacctcacctggtatccggccgagcagcgcgaagcgctcaaggaagccgccgatccgaatgccgcgccaactaacccgaccatcaaagacatgctcggcgtgctcaagatgcccacgctgtgggtgctcatcgtgttcatgctgctcaccaacacgttctacaccgtattcgaccagcagatgttccccacctactacgcctcgctcttcccgaatgaggccaccggcaacgccgtctacggcacgctcaactcggtgcaggtgttctgcgaatccgcgatgatgggcgtcgtgccgatcatcatgcgcaaggtaggtgtgcgcaacgcgttgctgctcggatccacggtgatgttccttcgcatcgggctgtgcggcatcttccacgatccggtgtccatctcgatcgtcaaaatgttccacgccattgaagttccgctgttctgcctgccggcgttccgctacttcacgctccacttcaatccgaagctctccgcgacgctctacatggtcggcttccagattgcctcacagatcggccaggtcgtcttctccaccccgctcggcatgctgcatgaccgcatgggcgaccgcacgacgttcctgacgatctccgccatcgtgcttgctgccaccgtctacggattcttcgtgatcaagcgcgacgacgagcaggtggatggcgatccgttcatccgcgattcgaagaagctgccgtcgctcgccaccgacgaggcgatcctctccgcggattccgaggatatgtaaagccccatccgcacctctcccccccgtcaatctctctcatatccctgcgtctcctctccctcccctcatttgcgtaaatagggacaaatggcagcctccaactgtccctatttacgcaatacaacctcaatcccggattccgaacccgtatacatcctgcaatcctgagtacaaggagacagatgtcgactgaaaacgtctccgattacgcaaacgaaatcagacagccgaatccgaaaggacaacgacgatggcaacccttcccaccaatattcccgccaacggcattctgacccccgacccggcgctcgaccctgtgctcacgccgatctcggaccatgccgagcagctgtcactcgccgaagcaggcgtgtcggcactggaaaccacccgcaacgaccgctggtacccgaagttccacattgcctccaatggcgggtggatcaacgacccgaacggcctgtgccgctacaacggacgctggcacgtgttctaccagctgcatccccacggcacacagtggggcccgatgcattggggccacgtctcctccgacaacatggtcgactggcaccgcgaacccatcgccttcgcgccaagcctcgaacaggaacgccacggtgtgttctccggttccgccgtgattggcgacgacggcaagccgtggattttctacaccggccaccgctgggccaacggcaaggacaacaccggaggcgactggcaggtgcagatgctcgccaagccgaacgacgacgaactgaagaccttcacgaaggagggcatgatcatcgactgccccaccgacgaggtggaccaccacttccgcgacccgaaggtgtggaagaccggtgacacctggtatatgaccttcggtgtctcgtcgaaggagcatcgtggccagatgtggctgtacacgtcgagcgacatggtgcactggagcttcgatcgggtgctgttcgagcatccggatccgaacgtgttcatgcttgaatgccccgatttcttcccgatccgcgatgcgcggggcaacgagaaatgggtcatcggcttctccgcgatgggtgccaagccaaatggcttcatgaaccgcaacgtgaacaatgccggctacatggtgggcacatggaagccaggcgagagcttcaagccggagaccgagttccgcctgtgggacgaaggccataacttctatgcaccacagtcgttcaacaccgaagggcgccagatcatgtacggctggatgagcccgttcgtcgcccccatcccgatggaggaggacggctggtgcggcaacctcaccctcccccgcgagatcacgctgggcgatgacggtgacctggtcaccgcccccaccatcgaaatggaggggctgcgcgagaataccataggcttcgactcgctcgaccttggtacgaaccagacctccacgatcctcgacgatgacggcggcgccctggaaatcgagatgagactcgatctgaacaaaaccaccgccgaacgcgccggactgcatgtgcatgccacaagcgacggccactacacggcaatcgtattcgacgcgcagatcggcggcgtcgtcatcgaccggcagaacgtggcgaacggagacaaaggctaccgggtggccaagctcagcgacaccgagctcgcagccgatacgcttgacttgcgcgtgttcatcgaccgcggatgcgtcgaggtctacgtcgacggcggcaagcatgcgatgagctcgtactcgttccctggcgatggcgcacgcgccgtcgaactcgtgagcgaatccggcaccacgcacatcgacaccctcaccatgcactcgctcaagtccatcggactcgagtgaacaaacgcagcaccgtaccagcggcggggcacaggcatcggcttgtgccccgccgctgttcttcgtgagcgcatgcccacagggtggcctatactgttgcagtcgccatgcacacgcatggcagagttaacttttctggtcgttcggcggtagactcctcaccttgctgcctgaagccggcggcctcacagcgcgacatgcgcagaaagtaaggtgccatggcttttcacagctcattgcgcaatcacacggaccgcccgcgccggcaagcgtggaggcattggcccaccgtcgtcaccgtcgtggcactgctgctcatctggcaggtctgggttgatgcggcccatccgcccgtcacgatggtctcctcccccacgcagatcgtccgctcggctatcatctcgtggcccaccctctggccagccacctgcatgacgttcatcgagggcgtgtgcggattcgccatagcctgcgtgctcggcgtgctcctcggcataggcatacactgctcccgtaccgcatatgcggcactgttcccgctgctcaccgcggcccagacgctgccgctcatctcaatagccccgctgtttctcatctggttcggattcgaaccggtgggcaagatcgtcattgtcgccgtgttcgccatcttccccattgtcgtgcagaccatgcgaggactggctgccgtccccgccttctatgacgacgtggcgatgacctgtggcgcctcgcgcgcatggacactgttccatgtggatctgcgggtggccgcgcgccagatcttcggcggcgtacgcgtgagcgccgcctatgtgttcgccactgccgccaccgccgagtacctcggcgcacgcagcggtctgggaatctggctgcaggccgcctacaattccttccagaccccgcgcatcttcgccgcgaccttcgtgatcatcatcatgaccggcttgctgctgctcgccgtgcacgccgtcgagcgactcaccatcggcgcgccggccgacgacgacgacccggacgcccagtgaatccacaaatctgcaaatccgagcaccaattcgaaagtgaccatatgaaatccccccgccatattcaccgacatctcactcgcatcatcgccatgctcgccgccctgcccaccatattcgcagtcacggcgtgcggttccacaagcagcgcgaacggcggcgatgacggcctcacgaaggtcacattcatgctgtcgtgggcgcccgacaccaaccacatcggcgtctatgtggcgaagaacaaagggtactaccggcaggcagggctcgacgtgaacatcgtcgccgtcgcacaatccggcgccgagcaggcggtgaacaacggcgtcgcggatttcgcgctctccaatctcaccaacgtgagcacctactccaccaaaggaacagaactccggcaggtgatgcagattcagcagaagacgagcgcgatctggtgcgcgctggcctcgaatgcatccatcacacgaccacgcgacctcgacggcaagacgttcgccaccttcggatcaagcgagtccgacgccgtggtgcgccgcatgatccagcacgacgggggcaaaggcaacttcgacaaggtgacggtgggcacctccacgttccagacactcgaatccggccgcgccgacttcggcggcttctactccacctgggaaggcgtgcaggccaagctcaacggaccgaaactcaactgcttcaccgaaccggaatacggcgtgcccggcaacgcggattcaatcggcatcatcaccagcgacagactcatcgcgcagaatcccgacctcgtgaaacgcttcgtgcaggcgacgcaacgcggctacgagtatgcgtatgaccatggcgacgaagctgccgacattctcgtcaaggaggcacccgaggcgaatctcgaccctgaattcgtgcgcgagtcaatgaagacaatcatcgacgggcagtactggggcgatcgcgaacagatcatctccggcaagcagacgttcggattggcggattaccaaggcacacaggcgatacttcgacttcctcgcgcaatccgacgcgtacacggacgcggacggacgtgtggtgcacgcagcgccgcagtcgaaggacctcgccaccgacgaattcctgaaacaggcgaactagcggcacgacggcaacgcgcagcaaccgcacacagcaacaaggcacacaggacatgggcatgacgaatccacagaccgacatacaccacatcgtggcgagcatggacaccggcatcgacgacgcgctcgcattggcgttgcttctcgcacagccgaacgtccgactgcatggcgtgagcgccagctacggcaacgtgctcgagcaaccggcggcgcgcaacacccgcgctgtgctgagtctgctcgggcgctcggatataccggtgttcgacggcgcaaggcatccctcatgggcaccgtatttcatcgccgacgccggttgcgcgcaattccacggcagcgatggtctgggagatgtcagcaccggcgacggcgacaatgccgacttcacgccgactacgcccggcgagacgctcgccagtgacgcgaatggactcgtcacactcaccgcaccacagattcgcaacctcaccgagtgcggcactgcgatctcggtaggaggttaccaagtgggcgagaagcacgccgatctgcccacgatgccagaactcacgattcccagcgggtctgcgcacacccccactcccgagaaactcgaattcccgcaggagagctgctcgcaggccaccgccggtgcgcgcatgatcgttgacgccgcccgcgcattcggccccgacctcacgatcctcgtcaccgggccgctcaccgacatcgacaccgcgctcacactcgacccggaggcggtgcggcaggcgcgcatcgtgttcatgggcggcaccctcacgcaggaagggaattgctacgacctcgtctgcgaaacgaacatgatccaggatccggaagccgcagatcgcgtgctgcgcagtggcgcggacgtgacgatggtcgggctcgacgtcacccaccgctgcctgctgggttcctccgacatcaccccttggaacgcggcgcataccgaggcctcacggttcctcactgcgattgcggagttctccattcgcgcgaacgcggccagcgagccgatcttcgccgccggcatgccgttgcacgatccgttggccgctgcggtggcgctcgatgcgacgctcgtcggcacgctcgacctgcccatgtgtgtggagacgagaagcggcgacggcaccggcgtgcgcggccgcaccatcggcaatccgcagggattcatcgatgcttccttatgccccacgcatgtggccgtgggcgtcgaccgcgaacgtttcctcgcgcggttcacgggcgacattgcgaatctgctcacctcgctacggtgacattcctaaagcttgcgcaatggcactccggcttcgagcagcttgcgaatgaaccgtgcgcaatcataggtctcgcgaacacggaagcggacgatccggtcgaccccgctgcgcaacagcagccgttcgcgctcgcgttcggcgtcgacaatctgctccaccgagtccccgccggtcatctgaacattcacatatttctcgttgcccaccgtgtgagcgaataaaccaaataacagccgcttgctttgtcccgggcatgcactcccagcgagacaaatcaagtaacggccacttgctttatctcactggcagatccaaattgaaacagagcaagtggccgaatagcagtcccgattcgcttgcaagggcatgcgaaagccgcgttctatttcttgacgccgccgaaacgacggtcgcggtgaatatagcggtcgatggaaccccacagcactacgcggccacaatccgggaacagctcgggcacgaagtcgagttcggcataggcggcctcccacggcaggaagttgcttgtgcgctgctcgccggaggtgcggatcaccaggtcgcagtccggaatatcgggattgtacagatgttcggagatcatcttctcggtgacgcggtcgcctttgatcctgccatcgcgcacctcgcgtgcgattgctgcggcggcgtcggcgatttcggcacggccgccgtagttgatgcagaacacgacatcgatcaccttgttgcgcttggtgcgctccatggccacctcgagctcgtcgatgacggatttccacagcttcggcctgcgccccgaccagcgtacacgaacgccccattcgtccatctgcgccacgcggcggtggatgatgtcacgcgagaaccccatgaggaagcgcacctcctgcggcgagcgcttccaattctcggtggagaacgtgtacaggctcaagtagcgcacgccggcctcgattgcgccggcgattgtgtcgaacaccaccggttcggcggcctgatggccgtccgtgcgaatgagaccgcgttgctgcgcccagcgtccgttgccatccatgatcacgccgacatgacggggaaccttgttcttcgggaaatccgggataatcgtggggtcggagaacggcgcggccggcacgctcaaggatttgtagtccactgcatcaaaagccatggttctaatctagcaagcgcagagaacgaatcggccgctcaaggtagtattgcgcccattcgcgaacgatgttctcgcaccgcgggtcgggcgtctgcagcatgtcgagctgcggccaatccccctgttcgagcgcccgcaactggtcgaacacatgcaccggcacgcgcacggcatctggcgtgtggtcattcgggcacattgcgccgcctgccgaagccgagaagaactccacgtcctgactgccgcacaccacgcacgagtcgaggcgaatggtccagccggccaatgacattgcgcgcagaatatacgacagtgcaatggcctgagggtcatgcagatgcctgctcaatgcgcccaatgcggcgatgagcaggcggtattgcgctgccgcgggctcgtgctcggcggggagcagatcggccgcggtctcgcacatcgcactggccgcagtgtaggtggcataatctcccgtgatgccgccggcatacgcacttatggattccgcctgccgcacgctgtcgaaggtgcgcccctcacccagcagcagatcgacgcgcatgaacggctccaagcgcgccccgaatctcgatttcgtgcgacgcacgcctttcgccaccgcacgcaccttgccgtggtcgcgggtaagcaatgtgatgatgcgatcggcctcgccgagcttggcggtgcgcagcaccacggcctcgtccctgtacaatgccatgcagccggctccctagaacctgaacaatccccagaaggagaagcacagcagcatcgagatcagcgtgatggtgaggatccagaagaacacgcggccgaatctgctggtcgcgatgatcggatcgtcgttgtgcacgagcgcacgccacgcgtcgcgattcataggccattgcaacagtccccgctgcgaccagatctcaatgattcgctctatcatcgacgcccatgcccacagcacgagaacgcaggcgaactgggtgacgggccagctccagtacatcatgccggcactagaatcgggagccttgccccacgccaattgcacgacggcgatcaccacttccgcgaaaccgcccaggaagagcagaccggcagccgccgtcattatcgcggtgaatctcagcgcgcgtgcaaacggtttgcgcatgcccatgccatgtgactggtggcgcactcgacgcatgatcgcgcgtatgagggtgaccacgagcagaacggccgatacgagcatcatgatgaggttcagccccatcaccacaatgccataccacgtcatcgcaggacgtgaatgcagttccagcggcactgcgatcgactggtagagcggtgttcctgcaacgggctcgcttgtctgtgtgaggccccgcgaggtgccggccacccacgacaccgtgtcgcgcatgtaatcgtcggcgaacggcgtgttctccatcgcctcgtctcccaaacgcagcacatggttcgcaatcgggtagctgcgcagcgtcacattgtaattgccggctttgtgtgcctgttcgagaatgtctttgaagccctgtacctgtgcggtcatcacgtccttcgccccataggccacgagggtgggaatgcggtaggcggccggcaccgatgtgttgaggtcggcgttcgtcaatcccagggccggcaggtcgagcgagaacacgcggcgcactatcgactggtacccctcgttcgcgccgacaagggcgaagtcctgcacggcgaggaatgcgagtgcgtgccgggcggagaacaccatgggcgaaagcagcacctggaaggcgacctgctcgtcccgttgcactacgtatgacgcaatccacgcgccttcggacgtcgcatagagtcccacgcccttcggattcacgttcctgaatccgcgcatcatgttgatgacctgctcgtagatcaccgcggagccctcatagtcacgggtcgtgtcgttcgtgttccacaccggcttgtctatgaccgctgtgacgaagccggcggatgacattgccgtggcgatgtcgccgaacgaattgtcacatgtgccgtagcccgcgccgtggaagaacatcaccgccggcagattgtctccggcaccttcgggctcccggaagttgatgttgatgcgctgcacgtcgccggtgctcggctgtttcgcatcgattgcctgatgccattcatgcaccttgtaagcaccttgtttgggcagttgctcacgtgtatcgaaggtgacctcggtgttcggcgacagcgtggcgaacgtctgtccggtgggcgtgttgtctgccggcagtcgcgtgtagttcgacgccatgacgagcacgccgagcagaatgataaagatcggcagtgtgatcatgagccgacgtgtgcggctgaagccctgccgctccggtatttcgtgagctttggacacgctgaatcctatcgatttgtcggtttcctgttccccgcgcatcggcgggcacagcttctacgcggttggcttccggtgcagattctcgccggtcagcggcatgacgacggggccggtgcccatgccatcctcattctcgcccatggtggctgcaatctcatgggcgtatttgagcagcgtctccacgattctgtcttccggcacggtctcgaccacctctcccttgatgaagatgcgtcccttgccattgccggacgccacgccgagatcagcctcccgcgcttcgcccggaccgttgactatgcagcccatcacggctacgcgaatcggcgcggtgatgcctttgagcccctccgtgacggcgttcgcgagctggatcacatccacctgcgcacgcccgcagctcgggcagctgatgatgtcgaacttgcgcggtcgcagaccgaggtattccaggatcttgcagcccactttcacctcctcgacaggaggcgcggagagcgagacgcgaatcgtgtcgccgatgccttcggcgagcagcgcaccgaatgccacgcaagacttgatggtgccctgccaggccggccctgcctcggtgactcccaggtgcagcggccagtctcctttggaggcgagcagtcggtaggtctccaccatggtgaccgggtcgtggtgcttgaccgagatcttgaagtcgtggaaacccacatcttcgaacatgcgcgcttccttgagggcggacgccacgagcgcctcaggcgtggggccgccgtacttggcgtagagctccttgtcgagcgaaccggcgttgaccccgatgcgcagcgagatgccggcgtctgtggccgccttgcagatctgcggacccacctcgtcgaatttgcgaatgttgcccgggttcacgcgcactgccgcgcaacctgcgtcgatcgcctcgaacacgtacttgctctggaagtggatgtcggcgatcaccggaatcggcgatttcgccacgatcttcggcaacgcatcggcatcctcctgattcggcaccgccacgcgcacaatatcgcagcccgccgctgtgagttcggcgatctgctggagtgtggcaccgacatcggaggtcttcgtgttggtcatggactgcacggagatcggcgctcccccgccgaccggcaccggccccaccatgatgcggcgtgacttgcggcgcgcatgcagcgggctctcgctcaccgccgcctcacctgtcttacggaacgttggctcactcatacctgtttggaactctttctgcggtactgcacggcatgcccgcgccagatcccgcgtgttctgtgtctggtgtgttgtgtcttgtgtatgcagactatcgcctgctcggatgtcgaaagactatcctttggcggcgatgatctcgttggcgcgcacgcgtgcctccctctcgagctcctcgacttcggccaccgattcgaacagcggattcgcgctcagctgcgcatccatctgttcgatcgtctcagccacgctcggcacaatgtcgagataggccagcctgccgtcaaggaaggcgtgcaccgcctgctcgttggccgcattcaacaccgtagtgtgtttctcggaggctttcaagcattgccgggcaagattcaccgccgggaacgcatcgttgtcgagaggctcgaacgtccattccgaggctttcgtccagtcgcatccgcgtgccacgtcatcgagacgcaccggggcggagagtcccaaggcgataggcagccgcatgtcgggcggcgatgcctggctgatcgtggcgccatcgcagaattcgaccatcgagtggacgatggattgcgggtgcacggtgacttcgatgttgtcggcggccacgtcgaacagtctgctcgcctcgatcacttcgaggcctttgttcatgagcgtcgaggagttgatggtgaccaccggccccatgttccacgtcgggtggttcagcgcctgctgcggggtgacggattccatctgctctcgtgtccaaccacggaacgggccgcccgaggcagtgacgatgagtttggagacctcggcgtgcgtacctgcgcgcaggctctgccaaatggccgaatgctccgaatccaccggattgatctggtgttcacgtgtctgcgcatcgaacaggaggtggccgccggccaccaccgattccttgttggccagggcgagctgggaatcggcctgcaacgcggcaatcgacggttcgagccctatggatccggtgatgccattgagcaccacggaagccccggcaccggccagtgccaccacctcgtcctgcccactgcgaatctgggtggcgtgggcgcccttggcgtccaatgcctgccgaagcggctcctcggcctgcgggttcgacaccaccacaagcggtacatggaacgaggcggcctgttcggccagcagctccacatgtgagcctccggcagccagaccggccacctcgaaccgatctctatggcggttgatcacgtcaagtgcctgggtgcctattgaaccggtggatcccagaatgatgactcgttgatgctctgcttccattgagcgttctaccctcagatttcaatccttgtgtgaatatgtgcccgctgattcactgcctcggggccgagtcacgtcccgacggcgcatcggggaacgcaagatcggggatgtcgatgttcatctggctctcacgaatatagcgtcgcacggcgtcgtcgttcgtttccaccgaattctgcgactgatcagtggattccgttgaggtgtgggccgatgacggcattggcaggtcgggaatcgatacgctggtgagcttcggcaccgacagcgtgtcgaagattgacttggcctcgtccaaggagcttgagctctgcggaatgctcgaggtctcatgcaccatcgatgccaacgacgacaacgtttcggaggtctgtggctgctcggcgacgaacggtttcatctgtgtcggtgcaaccgtctcggcattgtcggctttgtcatccgatgcattcgaatcgctcggggtctgggtggcgggagtggatggcgtctgtgcggccaccgccctttcatacgacggaatggtccgcggtgccggtgtgatcggctgtatggacgaaagggaggcatgcgaggcactatgcgttcccggacccaatgtgcttgcggatggcgtgtcgtgatcctccaccaccggggcaatcgtctcggttggcgcggagtcctcggagaacggcaaggcagctgccgcgaccggcgcggcaggcatctggctgatggtggccggcggaatcaccggcgatggggcagcggtgcctgcgttgaaaatcgcctcctcctgagcatggagttcgtcgaaactgccttgcgtggaatccgcctgccccatggttgcctgaaccggcgcattggagccgtcggctgcgatgcttggggatgtcgccggattctccggctcatctccctgcgtctgcggcacattggcgaacaatggcttgactccgttcaccggtgccgccgatgccgggcgttccaccgtgccggatgccgggatgctgccgttctcattgaggcgctggtaggattccagccggccgagcagatccgcacaggttgccagataatagtccacctgtcgctggtcatagccgcgcggccctttcaccacggtgaatgccgcattctctatggcctttgcattgagattcgggtaggggtcgttgcccaccgccggatgtgttccgtcggttgtcacctcggacagctcataggccgccttgtccatgatgtcatcgatgagttggtcgacctgtttgcgcttgtatgagagcatcttgtgctgaccggaggcgaatcgggcaccgtggtcacggtctgcatggcgctgcaattcgcgcagcgactcctccatctgcgctttccaggccacccgcccgagctcgctgatctcggcaagcgtctgcttgtcacacaacgcgcttttcagacggtcgagcatggcatccacattcgccggcacatacccgcccttcaccatggcgaacgaggcattctgaatgccggccaaggtgagcgagggatcgccttcgtcatagagtcgatgggcctgggccacgaaggcatccacctgacgtggatcataccccctggaatgctttccaacgcggggaatgctggtggatgtgctgctcgattcctgttcctgcgccatcgacgttccttccatactgtgtgccgtgggctgtctgggcatgccatgcagcccgacgaactacaaacctagctcaagaatacgttcgctcacagacccattacgctcgcggttgcgtatgccgccatcgcgaccgcctgtctttgacgattctagtcggttggcgtacatgccgcatccgagtcgtcgcatctgccacgactcttccacccctcctgtatagtggtctgttgcgggcgattagctcagttggttagagcgccacctttacacggtggatgtcaggggttcgagtcccttatcgcccacgtttcttctccgtaagccatatcgcctccggcgcttctctagattcctatactcggcagtatgaccagtattttcgaaagcgtttccaaccaactctcctcactgccgcatctgatcccctcctttgtgcgcaaaccgaacgagaacgatgagcggattgacgacctggagaatcagatcgcgcgtctcgaccgcgaatccaaatggtgcgatgtcgaactcgaccgccgaatcaaagagctcactgccgaggtcgactcattgaagcgcacgcagcatcatgaccgttcgctgcgcacggcggaccgtgtgctcgcaatcgtgttcatgtcgcttgccgcgctgattctcgtgccgatgttcctcaccctgttccatgtgatcgacccatccggcgagacgatccgctgggtggtcttcgcgctcttcgccgtcgcaggtggcatgggtgtggcgatcaccattgcacatggcaagctgccgcgcacacgcgactcgctcattgtattcgtctgtgcggcattgctgttgctggttgcctgcctgctctagcgtcgtccaccttgtgactgaatcccgtcgtcgcatacgcaaaggcccggcacatgccgggcctttgatgactgtgcatggatactccatggaattcggattcattccaaggagtcagccgttcatctgcctttgccgaacgcacgcagcagaataccgttccaatcatcgctcacggtgagcggagtcgccgcattcatacctgcggttttcgccgcgttctgcaccgtactcggtgatggagccccttcacggcccggtttgggggtgagcacccacagtgggccgtcgtcgcccagcactgcgtaagcatctacgattgtgtccgacagttcatcttcgtcgtcgccatcgcgccaccaaataatcgccccgtcgaccgcggaatcatattcctcgtcgaccagatcctcattggtgagtttttcgattttttctcggatcgagtcatccacgtcatcgtcccagagccattcctggaccaggtccccttggcggaagccgaactcctcagcgttgtctgatgctgtttgattcacgctcgtaaatataccaaagccatggaacaggcctgtttacaagccatgcgcgaatgaatcgtgactgttcggacacttgccgggcatccctctccactcagccgatcattctccggccatattatggtccgcggcccgtctcaccgtgcaatgcggcagcgaatccgcgtcgcccttgcctattttgacgagtgcggtataggcctcttcaagcgtcgacaccttcacatcgcgcaagccgttcggcacatgccccaccacctcatcacaattctcctcgggggcaaggaaccatgtcgcgccatcctgcagggcaccgatcattttcagatcgatgccgccaatagcccccaccttgccggtcttgtcgatggtgccggtgccggccacggtgacgccattcgtctcattctccggcgtgagtttgtccaccagaccgagcgcgtacatcatgccggcggagggacctccaatgtcttcgatgtgcattgagacgtcggcatcggacaccttggctcccagcctcttcgcataggccagaccggcagctgtggccgcctccattgacgagtccatatccgccttggcttcctgatcatactcctcgctgctctgccccaccgggaacaccgcctcactcggcagcacgttcatatgagggtcaagccaaccgatcagagcccagatgttcgagatcgggtagccgggcacgccgcttgcattcaccgtggtgagcaacagttcgcccctatcggggtaagtggtcgcattgctcacggagatcacctccttgccatcggccttgccgagcacgttctcggtggggccggggctctccaccacgtacgggctcggcgcaagcatgaggcacaacgcgagcaggaaggtgaacaggcctatgaaatagcgtttgggccgattgtgccagcgcgcgcgaagacgacggaacacgccatgaccacggccgggcgttccggggacatcggaatcgacttgcgagattgactcgggtgggttcaacgaagacatgcctccatagtatgggcaggtcttggccgccatgctccactacgatccacagccatgatgcattcggaatatttagcccgtattgtgagtagaaatgctagatacggactttatggacatacaggggaggatctgccatgagtgaagacgcgatccgtcaatggcttatcgaatgctttggaccggtacagggcgaacaggcattccagcagctgtcgatgctgcccgatgcgctgcgcgagcagctgatgagccaggattcctcatctcttccgagtccggaacagatgaagcagatgatgcagatgttcatgggtggcaacactccgatgggctccatgttcggtatgggtgaaccgggcaatgcggcgggaaccaatccggccggcttccatagcgccaatgcgggcgcccccactgacgccgcccagagcacagcacaatctccgacggccgacgagaacgcggccatcgacgtgaacattgcgaaaacgattgccgggcaatatgtcaacggcgaagacagcgagcaggtggtcacggcaggcgaaggcgagacgatgcgccgcgcgatgagcgaggcgaatctatggctcgacaccgccaccgaattcaacccggtggacggcgaggcgagtgtgctcacccgttccagctggctcaacggcaccatcgagcagtgggccaagttcgcctctccggtcgcctcgtcaatggccgacgccatgaacgccgtgatcaacgagcgtcttggcgaccagttcggaggcgagatcaccggcatgttcgccgggcccatcccgattccgattccggagagcatgcgcgacccaaagaagctgatgaagcagttggcgaaggcgacgttcagcatgcagctgggcaatgcagccggtgcgctctcccatgaggtgcgtggttccttcgaccagggtcttgccttgctgaagaacaaggctggtggcctcatcatgcagaacgtggaggaatacgcgaagtcgttggagatcggtgtcgatgaggtgaccacgttcctggcactccacgaggaggcctatgcacgtctcttcgccaccgtgccgtggctcatgccaaggttcgaggcgctgttgggcaagtatgcccgcggcatcgccatcgatctggatgcgatggaggacgagttgcgcgacgtcgaggggctcgaccccgattcgctgtcgagtgcgctcaatctcacgaatgtgggcatgggtgaagacactcccgagcagaaagacgcgatgcgctcgcttgagacgctgctcgcgctcgtggagggatgggtcgactgtgtgctgtggcgcgccggcatggcgcatctgccccacatcgagcagttgcgcgagatgatgcgccgcgagcgtgccgtcggcggccctgcggaacggacgttcgagaatctcatcggcctgcagctacgccccaagcgcatgcgcgaggcggcccagctgtgggagcgcatcaccgccgagcagggcatcgaggcgcgtgacgcaatgtggtcgcatcccgacctgctgccggcactcgagccggaaggcaatgcagacggtatggatgcggattccgaggcagatgcgacggaagccaaacacggcgacgacatcgattgggacgccgagctgagcaaactgctcgacgaatccgagaacggcaccggtgagggcgaatccacagaagatgccgatgacggcgactctggggaccagcacggatccggagattccggtgacagtgccagtgaagaccctgatagcggtacacttgagcaataacccaaaatccaacctcatacatgaacggggccttccatttgaagtggatggccccgttcgcattggtgttgccgaattcacgcacttactgcaggaatcggctcagccgtcgcacataggtggtctgcgaatccgatcgtttggcgaacgacaggtggagggtgtcctccgcacgggtcagcgccacgtacagcacacgccgttcctcctccacatcgccgtcatcgctttgcggcttgtagggcaatagcccctccgacaggcctatcacgaacacatgcttgtattcgaggcccttggccgcatggatcgtcgagattgtcacgcgccccttctccacgccaagctgctccaccccggcattcgatgtctccgcggtctcctgccgtgccgtgccggcgagcgcggacgactgccagttcatgttcctgcgcagccggtagggtatgttcgcctgtttcaacgcctgcgcgacaagggtctgctggccgcccacgcgcgtgagcaccgcgcagtcgctcgcgttgcctccctgcgcgagaatgcgcgagatctgccgtgcgaccgcctgggcctcggctgcgtcggtctcgtagatgcggctcatcacgcgcgagccggttccgcgcccagattcgagcctgatgtagtcctgtcgttgcgcggagccgccaagcacccggttcgcgtagccgacaatgggtgaaacggatcggtagtcgcggttcaacgcgatatcagcggtgagcggagcgaactccttgccgaaatgctcgagatagtagctggtggcgcccgcgaatgaatagatggtctgcgcaggatcgccgactacgcagatgttgcggttgcttcccagccagcgcgtcatgagcaggtgttgcaacggcgagacgtcttggtattcgtcgacggtgagccaaccgatctgcctgcggattcgcttggcgacgtcggggaaggcgtcgagcacgtggcatgccaacagcaggatgtcgttgaaatcgatctcgaaccgactgttcttctccgcctcgtactgctcgtagacggtggcgaactggcccggttcgagaccggccggcggtgtgcggtgcgtcgcagcgcacacgcgcgcatagttcttcgcggtgatcagcgagaccttgcaccaatcgatttcggcacccacctcgtacacgctctgtttcggctgctccttcggcctgattccgttgaagcgatacagtgcctgggccacaagcgcgcttttgtcttcggtgacgtcggggaaaggcccttcgcagatgtcgggccacacctcgcgcatctgacgcaatgcggccgaatggaacgtggatgcgcgcactccacgcggcacctgcaatgcgtccagacgctcgcgcatctcattggccgccttcaccgagaacgtcactgcgagcacccgggtgggatcccataccccgctcgcgcatgcgtacgcgatacgccgcgtgattgttcgcgtcttgccggcgccggcgaccgcgatgatgcgcaccgggccgtccactgccagcgcggccgagcgttgggcgtcatcgagcgtggcgagtatgcgctcaggtgaggtcgtgcccatttcgacttcgctgtgtgcgatggtcggggccccgttgtctgtgcccgcattcggctgtgctgtttcgctcatgccgccattgtgccacgggagcggcgaaagttgtagcaggtgcgtggaggaacgacgatgcccacggttcacggcccgttcacaacgaacgtaaagcgttgcaatcattggattttgtaccgtgtgcatgccatgattgcactgtgagtgagcgaagcaatctgaagttggcggcattggcttctgccacgatgccgaacgtgtccgtggcgggggttcgcgatagcgagcaggataacgacaccgaccgtgcggtcggcattgagcaggccgtggtgcaggatatgcgcgggcgtctgttcaatgtgtacgcggcatacgacccgcgtggcaagaagcggctccatgcccgtgggcgcgccgctgccgtggtcgaccgttctcgtgaattcgccgggctcggcttcggtaccgagcatgtactcgcattccatgcaggcaaggagggcccggaggacgcatctgtgctcatcacgacgcatccggacggcgtcgcgcgctcccttgagttgctgaccatagacgactgctcgagtttcggcaccgcgcttggtgcgattcatcgcctgcgccagaatttcatcacagacgcacactacccggtgttcaccaccggccagattcatgcgcagctcaccgcgtggatcaaacggttgcgccaggcaggccatgttccccaggaaatcacgagccgctggggtggcatcatggagaccgagggactgtggtcgttctccacacgcccggtgcacggcggtttctccgacggcgatctgatctattcaggctcctcgattaccgcgatcacgaactggcaggatatgcagatcaacgatccggcccgcgatctggcatgggtgttcgccaaactcgacgagacgcaccgcaacgccgtgatcaccgcgtatggccgggtgttgggcaatcgactcgacgacctgatcatgctgcgtgcgaatctgtgggtgcagatggagcaggtgggcgatttcatcaaggctctcaatgccggcgacaacgaccgcatcatggagttcaaggcacaggtggacaggctcgcccacaaactcggcgtctccgcccgcgccgcgcataccgcccgcccggcctccgatgccgccgcgacctcaggcaacgcaccgagcaccgtcaccgtgaacacgctgttgcgtgaggattcccgcacggccgctccggcgagttctgccggcttcccggatgactccacgaacgagaccgatgtcaccggttcgcgctcctattcgcaggtcatggatgaccgcacgaactcgcatccggtggctgccgtggacgattcgacgaacgattcgcctgtgctttccagcgaaaccgtgatcataggcatcaacgacagctcctcgcgcggcacgcagatcgtacgcgaagaggacttccactatgccgatgacgatacaatcggcgaccgcaccgattccaccgcctccgccgtggccgcaagccgctccgatgccgagacgacggtgattccgttgctcgagcgtgaggaacgcgcgatgcgcgacgcacgcgccggtctggagggcacgcaggggccggattcgggggcgggtacgcaggccgtctcgaccgacgggtcgtccgacgacctcgaccgtacgaacggctgagggcaacccattcgcgttcggccgctgggaatctgaaataactggcgagcaatgcgattgtatataacgtagctgtttgcagcggaaggcaaccgcagcatatcgaaaggactcgaaatggacattgaaatcggcattcagaacgtcgcccgcaccgtcaccttcaccaccgacgaggccgcggagaccgtcaccgccaccatcgaccgtgcattggaggaacacaagccgatcgtgctcaccgacaacaaggatcgccgcatcatcgtgccggcggactcactcggatacgtgatcgtcggctccgaacagcgtcacgccgtcggtttcggcaacctcggctgattcgcgggcttcggcatgaacaatgtgtgggccggacggttcctcccgaaccgtccggcccacacatttcaagccaagaggaggcggtgctcaacgacacagcggaatcgcaccgcgccgtacgatctctgccacggtggcgtcatcggtgagattctcgccaagcgcgttcggcttgcccgccccatgccagtccgagcctccggtgacgagcaggtgataccgctgtgccaatgcaagcaggcgcgcacgctggtcctcgggattaccgcgatgccatacctcaagaccgtcaagcccctcatcggcgaggcgcgcaatctgttcgttggaaagcagcacgcgattgcggctcggatcagccgcatgtgcgatcaccgagacaccgccggcaccctccaccgcacgcaccacctcgcttgtggatggcgacggcgtgggtatgtagtatttgctgtgcgtgctcaccgcatcggcgaacgcctcgttgcggttcgcgtacacgccggcggccacgagcgcgtcggcgatgtgcgggcgtccgattgtcgtgcgcgagccctccttggtctgttcgagcacgctctgccaggaaatcggataatccttggcaagcagtgcgaccatcttcttcgtgcgctccacacgcgagcgccgtgtcttctcgaacaggtcgcatatatgcctgttgcgtggatcgtacaggtacgcgagcatgtgcacggagacattgccatcctgcgcggtgatttccgtaccgcgcatcagcggcagatggaggtcgtgtgacgcctgcccggcctcctcccatccggcggtcgtatcgtggtcggcgattgccacaccatgcaagccgagtgacttcgcctcctgaaccatttcacgcggcgtgcgcgtgccatccgagaacacggtatggcaatgcagatcccagccctcctgcggcggtctcgttggcatgacatattcactcatggttccatcgtaaacgaatgtaaccgccacatgtgcagattttgagattctgcccggtattttctcccagaatgcgcacttgtgccccgccgttcaggttgcatacggtatcgtgaacgccagaacgtattcgcccggcggcatgaacgaacgcccgcgcagaccggaggatcatatggaacgccacccggaacagccatcaccaccacagtcatcgacgactttcaccgaccttaaaccgcatggttggcgcaacggggccacatggacctatctggtcatgctgctcgcctcgggcgtggctttgctggtctccttcgtgctgtcggcggagacgctgcagatggccaggcacccgggtcagtcgcttggatgtgacgtgaacgccgtgctctcctgttccaccgtggcacaggcttggcaatcggagatcgtcaaattcggcgagctgagcttcccgaacgcgttcttcggcatcgccgcggagtcggtgttcgtcaccatcgccgtgatcggcatggcccgcatgaccatgccgaaatggttcgcaacctgcacctggctcggctcgttggccgcactggcatactcgtactggctcacctcgcagtcgttgttcgtcatcaacgcactgtgcccatggtgcctggtgctcatgttcgccacgaccatccagttcatggcggtctcgcacgccaccgtgaccgtgcagcatctgccgccgcatgcgtcctcactgcgcacctactaccgcctcaacatcgatctcatggtcgatgcggtgtggatcgtggcgctcatcacgctgatcctcgtcaaagacggcgcgatgctgttccgctgagatggtgggtgtcgtgcgccggcctactgcaggagcctgaactcggcggtgagcgcggcggcgccggtgagcatcaccgagtcatcggtcacatcgacgcgcacgatgccgccgggaatgcgaatgcgccagtggtcaatctgcgtcttcgcacgcaacacgattgccgttgcacacaagccggtaccgcatgccatcgtctcgccgcagccgcgttcgtatacgcgcattgaggcgtcgcccaggtcacgctcggtgtcgaggttgtcgatgcgcgcgaactccacattctgcccgttcggcagttccggactcacctggggggcacgggtcagatcgagttcgcccaataccggcagcgtcgaataggcgtcctccaccacggtcaccacatgcgggttgcccatgtcgacgaacgttcccttgcccgaaccggtgtcacccggaatcgtgacggtgtattcgtcctccgcccccatcgaccacgagcccatgtccacgcgccataattgccgccccaattcggggttgtccggcatgcgcgtgatgcgcttgactccggcgcgcgtgccgagcttgaacgcgtcgccctcctcgagctccagcattccctgctgcacgaggaactgcgcggtggcacgcgtgccgttgccgcacatctcggcaagcgtgccgtcggcgttgcggtagtccatgaaccactccacgccctccttgcgcatcttctgggcgtcgtgtccgtccagatcggccacatgccccgggcgggtgatgcggatcaggccgtcggcgccgatgccgaaatgacggtcgcacaattggatgatgtcctgcttctgtggcgcgtgttccccactgcggtcggcatacatcacgaaatcgttgccggtgccctgcgccttgatcatatgttctggcaaactcataccgcccactctaccgcaaccgaagctgagatgtgcatatacgtgtagcgaagcggggaatacgcgcaggtctgtagactggagacttgcaatatcacccgcatgcaggaaagagactcccatgacctccagcgcaccggtaggcgtgttcgattccggactcggcggcatctccgtggtcaggcagattcgaacggatctgcctcatgagcgaatcctctatttcggcgactcggcgaacgccccatacggcacgaagactcccgagcaggtgcgcgacctctcgttccgcattgtcgaggatttcgtcgaacagggtgccaaggcggtcgtcatcgcctgcaacacagccacgtcgagcgccgtgcaggaactgcgggagcactatgacattccgatcatcggcatggaaccggcgctcaaggtggcctgcgaccgcgggcatggcgaacgccagagcgtcatcgtcgccgccaccccgctcacattgcgcgagcggaagttcgcggcgctcatgcatcgtttcgaggatgcacacaccattcataagcagccgtgcccgcgtctcgtcgaaatcgtggagcgtggagagctcgacgaccacgacctcgtcatgcgcacgctgcacgactatttcgaccagtacgacctcgcccacaccgactcggtggtgctcggttgcacgcatttcgtgttctaccgggactatttccgcgagttgctgccgaacaacgtcgcgatcgtcgatggcaacgagggcactgcacgccatctggaggtcgtgctcgaatccctcggcaaactcgcccccgaggaacaggacggcggcgttatcttgcgcaattccgacccgggcgagcgtatagccgaactcgcgcagcaactgctggagaggtagtctgcagccattcccgtaagacccaagcagatcagatgaggagacccgtatgacccacaccgcacacaccaccggaatcattgacgtcggcggcggtttccgcgccatcttcggggccggcgtcgaagaccgctgcctcgaggaggacgtcggtttcgaccactgctacggcatctcggcggggtctgcgaatctggcatcatatctggcgcggcagcagggccgcgcgcacacgttctacacgcagtacgcgttccgcaaggaatatgcgagcatggagaactacatcacgaaacgcaacttctgcgatctcgactacgtgtatggcacgctgagtaacagcgacggcgagaacccgttggattacgccgcgttcagcgacaatccggcgaccttcaccgtcgtggcggcaaacggcgaggacggctcgtcgcgctacttcgacaaatcggacatgcgtcaggacgactacacgatactcaaggcgagttccgcggtaccggtggcatgccagccggtggtgatcgacgacgtcccgtacttcgacggtggcatcgcggacccgattccggtgcagcgggccattgacgacggttgcgaccgcatcgtcgtcgtgctcacacgcccggtggacgtggcccgcgaacagcagagggacgtcgcgccggcacgcattctcaaacggcatcatcccgccgcagccgaacgtctgctcaaccgctaccgcacgtacaacgacgaggtcgcgctcgccaggcggtacgagcaggagggcaaggtgctcatcctctccccggaaagcctctacgggctctcgaccatgtcgaagaccttcgaaggccttgagcgcatgtaccgcgcaggctacgcccaggcagcgcggattcgcgagtttctcgactcctgatatcgtccggaccacacatgcgcaaatgccggggccgtggaagtttccacggccccggcatttgcgcgtatgagatcagttctgtggactggattcctgcgtggtgagcatcgcctgcgtcatctggtcgaacagctccgaatagccgcctggcgtggccgccggcatcaccagcgtcttcgcgttcttcgattccgagagcgagcgcagcacatcgagatactggttgaacagcaccacgttgttcaccgcgccaatgtccatgccgacttcctgcaggctcttgatctggtccacaatgccatcggcgatctcgcggcggtaattcgcctggccctcgccctgcaggcgcaccttctctgcttcagcggccgcctgggtctcgatctggatgcgcatggcctcggcatgctggcgagtcgcctccttttcgcgctgggccgcgttgatcgagtccatggccgatttcaccgcggggctcgggtcgatggccgtgatcagcgtcttcaccacggtgaagccgaagcgcgccatttcggaacccaccgtctgctgcacgtcggccgccacggaatccttcctggcgaaggcgtcgtcgagcgtgagcatcggaatggccgaacgcagtgcgtcttccatataggaacgcagctgaccttgcggatcacggagctcatagtaggccttcgccacgttgtccggattcacgcggtactgcgtgctcgccacgatcgtgacgaacacgttgtcgagcgtcttcgtctccagtttcacattgagctgcgagacgcgcatattcgtcttcatcgcgatgcggtcgacgaacggaatcagcagatggatgcctgcgaatctcacggagcggaatttgccgaatcgttcgataatgtacgcctgctgttgcggcaccacatagatcgccatgcacagcagcacgatcaccaccaatgcaatgacgccgattccgataagcgatgggctcatgttctccctctttctgtgtcccgtacccggtattcattcgggcacctcctctcaccgtatcgaaccgcggattcccctcccattgcgttttcgggagatggaatttttacgacatgtttggtccacgagctgagatgaacggtccgcatacaaaacgggcgcctcctgtacggaaggcgcccgccctgttcacccgcgatcacacgatgtgatcgcgagtcgaataccgactcatttctcgatcacgccggattccaccacgatgtcgtccggattgacctcatcgccgtacaccggcttgagcgtcttctcgaagtccttgtggaagaagttctccttgccgagcttcacgatctcgtcgttgatgtagtcgagcagctccttgttgcccttctgcaccgcggcggcgatcacgtcgacgtcgccgatctcggtcacgtcgacacggtagcccttattggccttggcccatgcgagcacctcggtgttgtcggtgctcatcgcgtcgccgcggccgtcgagcagcgcgttgtaggcgtcggcgtactggtcgtacttctgcagcttgatttcggggtgattcttctcgaagtaggtttcggcggtcgtgcccttggccacgatcagcgtcttgccgttgaggtccttcacgtccttgatcggcgccgcatccggtgccacaatgccgagcgcgaccttcatgtacggcttcgagaagtcgaccttctcggcgcgttccggggtctcggtgaagttcgcgagcgtgacgtccaccttgttcgacgcgagcacgtccacacgcgccgccggatcgaccgacgtgtacacgggcttcactccgaggccgtcggcgagcgcctgggcgaactcgatgtcgtagccggcgtacttgccatctttgtccacatagccgaacggtgccttgtcggagaacaccgccacacgcagctcgcccgacttcttgatctcgtcgagcgtgcgcgccttggcgttcgtgctgttctgcgtattgccggaggcggatcccgcctcgctcggcgtcgaagcggacggaccgcaggccgccacagcggtgatcatcatcactgcggctcccgccgccgcgactgccttacccaactgtttgaaaagtgagctcatatttccctttcgtgcccggtttttccttgtctctttccttatggaaatctaattgtgtgcagactggccgtctcccgtgccatcctcgtcgaacgcttcaaggcgctcatgggcctgtgcgctgcgatggcgttcgaagtcgaaggaatgcaggaattccttggcgcgctcggtctgcggatcggtgaagaactgctcggcattcgtggagcggtctgcgatctgcccgtcggcgagcagaatcacccggtcggcgatggcacgcgcgaactgcatctcatgcgtgacgatgagcatcgtctgcccggcatcggccagttcgacgaccacctcgagcacttcatgcaccatctcggggtcgagtgcggcggtgatctcgtcgagcagcagaatctcggggtgcagaatcaacgcgcggcagatcgccacacgctggcgctggccaccggaaagctcatgcggcttggcctgcgcgcggtcggcgagatgcacgcgatcgagcagttccatcgcctcccgctctacttcagccttctttcgcttctgcacgagcatcggcgccatggtgatgttgccgagcacgtccttgttcgggaacagctcgtagctttggaacaccatgccgaacttcgtgcgcagcgactcgggccgcttcgcacggccggatttctcgttcccgggcttgcccgtttcgatcacctggccgtccagtgcgattgtgccgccctgaatcggctccagaccggcgatggcacgcagcagcgtggatttgccggagcccgacggtcccacaatcaccagcaccttgcccttcggcaccgagaacgagatgccgtcgaacacgttccgatcggcgtccgcgtagtgcttgagcaggtcggtcacctgcagtgccggcacgtcggccggtgccgtggcaacggaatctgtacgctcagtcatttgcccacctcttttcgagtgcgtgcgccaccaacgacaacggccagcacactatgaagtacatcaggaagatcacgccgtacacccacagtgttccggtcgggtactggaatcggttcgcgtcaatgatctgctggcccaccttgatcacctcgaccacgccgagcagcacggcaagcgacgtcgtcttcacaatgcgggtcgaaagattcaccgcaccaggcaggaggcgacgaaccgcctgcggcagaatcacatggacgaatgcctgccagttactcaatcccagcatgtaggaggtctcgtattgaatctgcggaatcgattgcagcgccccacgtacgagatcgccgagctcggcaccgccccacagcacgaacacgaacacgcatgatgccgtggcatccatattccagttcgacattctcgcaatgccgtagaacgcgatgaacagcaacgccaactgaggcatgatgcgaatgaagtcgagatacacacgcatgacgaagcggatgaccgggttgcgcagcgtcatcagccagccgcacaacaatcccaacggaatgctcaacccgacggagaccgcggcaatccagatcgtcacccacaggccctgcagcaggcgggggaacacgcccggttcgagcaggatgttagcgccttgcatagtcgaacctcctctcaagccaagtgccgagaatggagatcggcagcagaatgatcagataggtcacgatgagcatgaacagcgcctcgtaagtgttgtaatacatgcccatgaggtccttcgccatgtacatgacgtcggcgagtgcgatggccgagaccaccgacgattccttgatgaggaagatcacattcgccacaatgcccggtgtggatatgctcaccgcctgcggcacgatcacccgcgtgagcgtctgccaggtgttgaagccgagcatgtacgcattctcgcgctggatctgcggcacggattgcagtccggcgcgcatcgattccgccatgtaggagccaccgaggaaccccagtcccacgatcgcgcagagctccgcggaccagacgaagcccatcttcggcaaaccgaagtagaggaagtacagctgcaccagcaatggcgtgttgcggctgacctcgatgtagacggtggtgatctgcctgagcaccgggattcgcgcggtctctatggccgcgcagatgatgccggtgagtatcgcgagcgcaatgccaaacacggagatgaacagggtcatccacgcgccgttcacgaagaacggggcatatttggccacgaatgcccaatcgaacatgtatgggcctccctttgctgctgtctgtgctgtattcgttggctgtggctgcgccgtgcgccacgccaagcgtgtatgagtcacgttacgcgtgcgccacgccactcacatactgagattgcatgatgagattgacgaatgccatacggcattcgaattggaatgcgacaatcaacaacaacaggtgccgatgcgcttgaccgcctcggccaggcgctcatcgggctgcagcaggctcaggcgcacatactgtgcgcccacgttgccgaagcaggtgccgggtagcaccgccacgcccgccttgtcgagcaggtcgtcggcgacctcctcgccgctcctgccggcaggggcatgcatccacacatacagtccgccctgcgaatcgaacagatcgtacccgagttcgcgcaggccatcggccacgatggcgcggcgacccgcataatgcgcggcctgccttccgacgcaggtctggtcgctgttcaacgcggccacaccggcatcctgcacgaacgaagtaatcatagaacccatttgatagtggaaattcttcgccacgtcaagaatgcgttcgctaccggcgatgaatccggcacgccatcccgccatcgcatacatcttcgagagcgagcagatctccaccgtgcactcccgctccggcgacccggccggcgtatgggccacgacctcgagcagactgtgctgctgctcctccacccccaagccggcgtaggcgaaatcgtgcacgaccacgaagtcatgttccacggcgagtttcacggcctgttcgaagaacgccaacggcgcctgcgcgccggtgggattgttcgggtaattgagcacgagcagcctcacgccatcccacaccgaagcaggcaccgcatcgaggtccggcagccaacccaactcggccttcgcgggaagcagcacctcatgcgcgccccgcatattggccatgcaatggtaggaggggtagtacgggtcggcgaacgccaccgcgtcgccctcgtcgagcagtatgctgaacaggtcggccaggccatccacggcaccttccaccgcgaacagcccgcggttcgcatcaagctcgacgccatgcacattgcgataccagttcgcggccgcctcgaggaacgccggcttgccgtcgaacggcgtgtagcgtgcattgagcggatcgtccacggcggcacgggtcacctcgcgaatgaactcctcggggaaaccgtcgggattgcctttcgacagatcgatcacatcgacgccccgaccccgtgcggcgagcaccttccggtccatgcgctcgaacacgttcggcggaatctgcgatgccaccttggcgaaatgaatggccatgccttctctcctcgttctcgttccttgttccgcgcgttttcccttgcgtccagagccatcaggcacatctgcccataccgcgcatggcatggacggaaggtgacggacagtgcgagcgtaacccagcagtgttgcgtgcggattgtgaatgcgttgcacagcaagcgacttctccataagcacattaagcgcgcactcgactttcgcggatgcgcgccatggacgtacggactcagtgggtgaccctgacggcgatgcggtcgcccacccactggatcacctgtacgagcacgatgagcagcagcacaatggcgacgagcacgccggtctcataacggttgtagccgtattgaatggccagatcgccaatgccgccggcaccgatggtgcccaccatggccgaatagccgagcagcgagatgatcgtgagcacaatgccgcgaatatagctgggcaacgcctgcgggaaaatcgcgccgaagatgatctgccgcaacggggcgccggtggagatcgccgcctcgagcaatccttcatccacctcctggaatgcgctttctgccacgcgagcgaagaacggcacagcggcaatcgacaatgcgatcgcgccaccggtgggcgtgtacggatcaccgatgagcagttggatgagcggaatcaacacgacgagcagaatgaggaacggcatcgagcggatcgcgttcaccacgaacccgaccatctcattgaccgcatggttcggcgtgaacagtctgtgctgcgtgaggtagagcaacacggcgagggcggtgccgagcaccacgccgaccaatgtggccacacccaccatgaagaacgtgtcccacagcgctttgccgagattgtcttgcagaatctccaacgtctcgctcatgcgagcacctcctcgttgtctgtccgaacatcgtttacgtcgccgtatgtgccgatcaaccgatcggccgccgcttcgccagcgaatgcctcatccaccgaatgccccagatcgtcgttcaggtcttcgctcagctcacgccatgaatggacgtgctcggcgagctcgtcgatggcatcctgcacgatctgcgccccctgctggccgccctgtcgcgcactgaccagcacgatgagcgtgcccacggcctgcgtgccgaagtagcctacattgccgtgcagcacgttgatcgacacgtcgtggtgttgagcgacctcgctgatgagcggccggaacgcaccaccgtccctgtaacgcagctcgatcagtcgcccaggcggcagttgcggcaccagctgctcaggaatcgcaatgcccagataacgctccaccagcgcctgcgtggtcgggtgatgcggtgacgagaacacgtcgaaggtggtgccctgctccacaatcacaccttgttccattaccgccacgtcatcgaagatggccttcgccacatcgaactggtgggtgatgaacacgatcgtgatgcccagttcggtgttaatgcgcttgagcagtgtgagaatctcctcagtggtctccagatccagtgcgctcgtggcctcgtcgcacaacagtatgcgcggcgagttggcaagggcgcgcgctatggagacacgctgtttctggccacccgacagactggatggatagctgtccgccttttcggccaatcccacgatgtccagcagctcctccacacgggcgcgacgccccttcttcggccagccgcccgctttgagcgcgaattcgacgttcctgcccaccgtcacattgtcgatgagattgaatccctggaatatgaacccgatcttcttacgaagctcacgcagtgctccgcccttgagatcggtcacgtcatgtccgtctatgatcacctggccctcggtaggccgctcgagcaggttgatcgtgcgcaccagcgtcgacttgcccgcgccggagaagcccacgatgccgaagatctcgccttcgcgcacatgcatggtgacgtccttgacggcttcgaccgtgcggccgccctcacggaaggtgacggagatgtggttcagttcgatgatcgtgctggaatccgtgttctgtacacccatgttccctcgctgttcatgcctgcggtgcattgtctcggtcacttaagccgctcactcggcccacgatgccggcttgccgaagtccttgaacttgctggcggcgatggcctgcctgaattcgtcactaccgagcaaatcgcgcaccgtcttggcgaaatgcgtgtctttgttctggccggcaatggcgaacacctcgatcaccccgtcgtcctgctgctccagggcaagcgcgttcttcgggtcgagaccggcggcccaggagtagttgccggggacgagcgagacgtccacggtgtcgagcgaacgagccagctgggcagcgtcgatcggcttgatgttcaggtgcttcggattgctggtgatgtcgttcaccgaggccttcgtggcatccacaccgtctttgatcgtcacgagcttgttctgctggagcacgccgaggctgcgggcgagattcgaaccgtcgttcgcaatggccacggtggcaccgtccgcaatctcatcgatcgagtggtacttgttcgaatagatgcctagaccaagcgtcggcgtctggcccagcgaaatgagatccagatcgttgtcggcgctgaacttcttcaggtagttgccgtgctgcatcaggttcgcatcgatcttgccggaggccaatgccttgtcgggctgcacgtagtcattgaacaccttcgtgctcacctcgtaccccttctccttgagcagcggcgcgaacacctcctcgaccatgtcgccatacggtcccgcgcatacgccgatcgtcaccttcgtcgtcttgccatccacaggttcggcaatgccttcggcgctggcgttctgcgcggtgccgcaggcggcagtgccaagcagtgtcgccgcggcaagcacagcggcgaaggcgcgcgtgagtgtcctacgcttcgatttcagggtggtgaatgcggttgcgatggtcatgggtcttctctttctctcgtgactgcggattccgggcagcgtcggcaatgcagcgtcaggcaatccgtgaatatgaaatctgtgagtattgaatatggcggtggggaggccgtgtcagtctgcgagttccacggactgtgaggcagccttggcggcgatgtcgggatgatggatggcgaacgcgtgctcggcgagatgcacctcctgcgtcacgaactcatgcagcgggcaggcatagccgtgttcgcgccccaggcgtgcgatgtagccgttgatgtagtccacttcggtcggccggcatctcgtcagatcctggtacatcgacggataatgcaacggatgcgcaatcgaagccgtgtgcattatcgtctccacctcgctttcccgcgtgccgagcaattgcacgccggcggcctcggcggccccatatgcctcgtcgaccagtcgttcggtgagaatcggagccgcggggtgcgaggcgaactcgccgaagcgaatctgatacattgtgcacaacgtgttgagcaccgagttgaacacgatcttcgccaggcacatgccgaggaaatgccgcacgatggtcggattcagcgtggccgcctggaaatcggcgaacagctgccgctcgattggatcctcctccacatcatgctcgtcgtacgcgcacaggttcatcgccttcgcatgtgcgcctccggtgaagttgaaatcaccgggaccgtacacatacgcgccgatcagcgccgttccgccataaatgcgatgcttcgggaagtactcggcgagcttttcgaaatgcccgtagccgttcatcgccgagaacaccacctgatgctcgcggaaatgcggcgcggtgcgctcaagaaattcgggaagctgatgctgtttgacgaacacgatccatacgtccgggtctccggcatactcctccgggtagtacacgttgatcggcaccaggtggcgtccctcaccgtcctgcgacacataggcaccaccctgttcgcgaatcttctcgacgttctcggtccaggtgtccacgaaatccacctgctgatgtgcgaattcctgcaacagcacgccatactgaatgcccatgccgcctgctccgagaatcgcgtatttcactgagatcccttcctttcgttgctctctgcccgttcggcaatgcatcccgttctcaaggagctttactcgaaccgacagttgacactgtacgaagcggcggcgggcgattcaccggcgtggctatagccaaaactgatatgcggctcaatactggtgaaatcacaggcatctgcctaggtataagcaaattcgaatacgtgttatatccataccgcccggttgggaggtccatggcaacctcacggcatcgctgccgcaccattcatgcctcggacgccgccatttcagctcgcgggcgcgaaaacaccgcttcgcccgcaattgggtatgccctgagagagtatgttccttatgcttgttcgacatgcgacgcttgacgacctcgacgcgctggcagcagtggaggccgcgtgcttccctccgcaggaggcggccgacatcgaccaactggccaacagagtggagagctatccaaaccacttctggcttctggtgaatcccgccgagccggacaacgactgcttcccagcccaggtcgacgacggcatgctcgtcagcttcatcgacgggccatgcgtgggctcacccgacctcaccgacgatatgtacgcctccacggccctgcatgcggacgatgccccttggcagatgatactcggcgtcaacaccgcacccatgtaccagcatcgtggctgtgcctcgttccttatgcgccacgtgattctcgacagcgcgctttcgcacaggcacggcatcgtgctcgcctgcaaggagaaaatgttgccattctacagctcgttcgggttcattgacgagggccgcagccaatccgtgcacggcaatgcggtgtggcaccagatgcgtctgccattcaccacctctgcagacgcccgcgacgacgctcccggtgcagacattcgccaggcgacaatcaccatggccatgcatgagacaaccgcatacatggatcacgagcgcacaatcacatcacagttcccgcagctggtttaagcgccatctttataatctatacacatattttttactgcacgcgcacagtgaccccacgtttatagtggaatcgtgaatgattgcgtatgaattgcgacgataatactttgccgcgtatgttcatggtgtgttccgatagactggtaaacaagaaaaacgaatattttattgcgtactacaatggaagtagtaatttattcggcaagaagaagggtgcagggaactgcaggcagacggtagaaacgaggtggccatgaagccagcatcgcgaatccccatgaattacatctcactcgatctggagacgaccggcttcagcgcacagaatgaccgtatcaccgagattggcgccgtcaaagtgcgcgacggcaagatagtggatcggttcacgcagctcgtcaatcccggcaggcgcgtctccgcacgcataacggagctcacgggcatttccaacgagatgctcgaagaccagcccgtcatagaagacatactcggggatttcatacactggaccgagaatgaccgtttggtgggacataacaccaaattcgatctctcattcctcattgccaatgcggaacgtgtgttcagcgactccacacgcttttccgtgcgtcccattgacaccatgcatatagaccgactgctgttcccctctgaacggcatcgtcttgtcgatctgatccagcgttacggcattggcgatgttgaggagcaccgcgcgctttctgacgccacgcagacgtaccaatgcttggaatggcagcggcgttatattgacacccgctcggcagacatctccatgcgtacgtgcgtgtgatcttttgcacaagatttcatatgcaattcgcccatcgctcatgcggtgggcttttgctttgctgaataggcatgctattgccgatatgctggcaaggtatgaaatgaccccaggagaggcatgtaggtggggagaaaatagtcgggagttgttgttcttccggtttggaggggtgttcatgggatgaagatcgcgcggtgtgatatgctccccggttcggcggtgtccgtgtcgggggttctgcgttgtgcccgggatacggggaaggcccggggaacgtgtgttccccgggccttcggtgaagtgtggttgcggcggtgtgctactctcccatgtcctctcgggcatagtaccatcgccgtgccagggcttagcttccgggttcggaatgggaccgggcgtctcccctgggccatggccgccgcaaaatctgttatcctgtctgcgggtggcggttcgggaaccggatcgtggacgcgagtgagggacttggtgttcgtgccgccgtgatgccgccggggttttccggcttcgtcatggtggtgttggttgtcttcgaccgttagtgccggtcggctccacccctcgcggggcttccacgtccggtctatcaaccacatgttctctatggggtctcacacacccccggggggggtgtcaggaatccttatcttggagcgggcttcccgcttagatgctttcagcggttatccctcccgaacgtggccaaccagccgtgccgctggcgcgacaactggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacgccggcaccggatcactatctccgactttcgtccctgctcgatccgtcgatctcgcagtcaagcccgcttgtgcgattacactcgacacccgattgccaaccgggccgagcggacctttgagcgcctccgttactctttgggaggcaaccgccccagttaaactacccgccaggcactctccccgacaaggctgacttgtccgggttaggcatcagatggggacagagcggtatttcactggccggctccaccacggctggcgccgcggcttcgaagcctcccgcctatgctacacaatccgcacctgatgccaataccaaggtatagtaaaggtcccggggtcttttcgtccttctgcgcttaacgagcatctttactcgtactgcaatttcgccgagctcctggtcgagacagcggggaagtcgttacgccattcgtgcaggtcggaacttacccgacaaggaatttcgctaccttaggatggttatagttaccaccgccgtttaccggggcttgaattcaccacttcgcatcccgcgaggggacgctgatggatcctcttaaccttccggcaccgggcaggcgtcagtgcatatacggcgacttgcgtcttggcatgcacctgtgtttttggtaaacagtcgctaccccctggcctgtgccacccccagccgcccacgacccgcaaggggccggcacggccgggggtctcccttatgccgaaggcacgggagcaatttgccgagttccttgaccaggattcgctcgatcgcttcggtatactctaccagaccacctgtgtcggtttggggtacgggcggcaacggacctcgcgccgaagcttttctcggccgacgggatcaccggatatcacgccatgaaagcgcccatcatcacgcctcaccccatgaagcccccggatttgcctgggggcggggccacacgcttgaccagggaaaaccacctccccggccggctacccgtccgcgtcactcctgaaacgctcaacccatgcgcgtccaggccaaacagcaacggaatcaggaggccgaagcccccatcaaccgtatcggatggcccttgttcacacgggctgttggtcggtccgaaagccggtacgggaatatcgacccgttcatccattcgactacgcctgtcggcctcgccttaggacccgactcacccagggacgacgaacgtggccctggaacccttggtcttccagcggcagggatcctcaccctgctctcgctactcatgtctgcattctcactcccacacagtccacggccgggttcccccgccgcttcgccccggtgtgggacgctctcctaccacacggccatacggccgcatccgcgtcttcggtggcgtgcttgagccccgctacattgtcggcgcggaaccactagaccagtgagctgttacgcactctttcaaggatggctgcttctgagccaacctcctggctgtctatgcgactccacatcctttcccacttagcacgcgcttggggaccttagacgacggtcagggctgtctccccctcgacgacggagcttatcccccgccgactcactgccggaatagacgcgatgggtattcggagtttggttgctgttggtacccggcacgggcccgcaagcatccagtagctctaccccccacacgcaatcaaccgacgctgcacctaaatgcatttcgaagagaaccagctatcacggaatttgattggcctttcacccctaaccccagttcatcccctcagttttcaacctaagtgggtgcggtcctccacgcggtcttacccgcgcttcaacctgaccagggctagatcatcccgcttcgggtccaggacacgcgactgaaaagacgccttttaagactcgctttcgctacgcatacaccacacggcttatgctcgccacatgccactgactcgcagactcatttttcgataggcacgccgtcaccccaccaagggggctccgacggttcgcgggcgcacggtttcaggaactctttcactcccctcccggggtgcttttcacctttccctcacggtactcgtacgctatcggtcagacaggtatactcaggcttacccgacggtccgggcggattcacacgggattccacgagtcccgcgctactcgggagacaccatccatggtgcacgcgcatacggctacggggccatcaccctctacggcccggtatccaacccggttcgcctcacgcatgcatttatcaccacagccaacggcgtcggccgttggacaggcgttcccacgacaccatgcgcgcaacccccgacgggtatcacacgcgcacggtttagccatcatccgctttcgctcgccactactcacggagtatcctctcctgcaggtactgagatgtttcacttccctgcgtaccccccgcacaagtgcggtgccagcccatgacggctggcgggttgccccattcggacaccctgggatcaaagccatgtcggcggctcccccaggactatcgcggccccacacgtccttcatcggtactgtctgccaaggcatccaccatacgcccatcacgacaaccacaacacggccgccatgaccaaagcactactgaaaaaccctagaacgacatcagatcacggggacgcaccacacacggcacgcccccatacgattacgaacgaacccaagaaaaaacaattcctcggatccgaatcacagtacgaacaccaaccccaccccaacgggcgggccgatgctcgcgtccactatccagttctcaaaccaccaccccaccaggacacccaccccgcaccaacaggcaccgggcaaccgacctgggggacacactggcaaccacaccccacaccaggggccggtggcggccagggaacccaacagcacgcaccacaccacacaatccaatacgactcttccacgccagcaagccagggcggcgacgacaaaccatcgcactcggcaaaccccagccacaaaaccgtgcacaaaaccatgcacgcccatattctccgtagaaaggaggtgatccagccgcaccttccggtacggctaccttgttacgacttagtcccaatcacgagtctcaccttagacggctccccccacaagggtcgggccaccggcttcgggtgctacccactttcatgacttgacgggcggtgtgtacaaggcccgggaacgcattcaccgcggcgttgctgatccgcgattactagcgactccgccttcacgcagtcgagttgcagactgcgatccgaactgagaccggttttcagcgatccgccccacgtcaccgtgtcgcaccgcgttgtaccggccattgtagcatgcgtgaagccctggacgtaaggggcatgatgatctgacgtcatccccaccttcctccgagttgaccccggcggtcccacatgagttcccggcatcacccgctggcaacatgcggcgagggttgcgctcgttgcgggacttaacccaacatctcacgacacgagctgacgacgaccatgcaccacctgtgaaccggccccgaagggaaaccgtgtctccacggcgatccggcacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacgggacccgtggaaagggccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactccagcccgcccgtacccggcgcagatccaccgttaggcgatggactttcacaccggacgcgacgaaccgcctacgagccctttacgcccaataaatccggataacgctcgcaccctacgtattaccgcggctgctggcacgtagttagccggtgcttattcgaacaatccactcaacacggccgaaaccgtgccttgcccttgaacaaaagcggtttacaacccgaaggcctccatcccgcacgcggcgtcgctgcatcaggcttgcgcccattgtgcaatattccccactgctgcctcccgtaggagtctgggccgtatctcagtcccaatgtggccggtcaccctctcaggccggctacccgtcaacgccttggtgggccatcaccccgccaacaagctgataggacgcgaccccatcccatgccgcaaaagcatttcccaccccaccatgcgatggagcggagcatccggtattaccacccgtttccaggagctattccggtgcacagggcaggttggtcacgcattactcacccgttcgccactctcaccccgacagcaagctgccagggatcccgttcgacttgcatgtgttaagcacgccgccagcgttcatcctgagccagaatcgaaccctccacaaaaaacattgcagaaagccaaaaacgactctcaaatccatttcaaaagaaatcagacggaccccctaataaggaaagggagccacacaaaaaacctccgccatccatcaaaacccgacaggattacccacacgaaaccatgcaggcggacaacggaactggcatcataaaagacgaccaagaaccacaacggccacgacagccgaagcgacatcaaccttggtcaagtagtacagtacacgctattgagttctcaaaccaccaccacacacccacaaccccgacccgggaaccccggcaggccgtgagcggcagcaaaagaaaaacctacaccacaacccccacccacgcaaccccacccccaaccacacacccccaaaccccaacaaacacaacaccaccaccggcgtgtcgaaaaccagccaaaccccaaccacccccccccacgacacccacaaagacacaaaccaatccacaaacacacaagggagaaaccaccacaggagacaacccccaccccaccttttccccagacgtgaaaggagacgaaacccacgccccaaacgacccaaattacgcaggctgacacagccaagaacaggacgcacaaccaagaaaatccctccaacaggcgccccgcgaacagacgaccactgcagaacagacggccgtcgggcgggatgccgacggagccgcaggctcaccgccaagaagcacgccagcccccgccacggcagtatcgcccaccgaggaggcggatcccacagcagccatcacccgcatccgtacaccacagaaaagtcaccgcaggtgttgcgcctcgaatgcgcgggcagagttgctcacacccagattcgtggaggagaagtgcaagttgcgccccggatgcgcggggcagagttgaggaacgtaagggagcgtgcgacagtgacgaaactctgccccgcgcatccggggcgcaacacttggggcaataccgggggcaacgccaggggcacaatctgaggtcggcaacattccaaccatgcacacaaaaccgccatatcgtccctcgaaccaatgattccaaaggctcaccacatgcctcacgcgtgtcggcggggacattgcacttgcacttgtccgccagatgacgtatgttgttactcgcctcgggcggttggcgcagtggtagcgcacttccctgacacggaaggggtcacaagttcgaatcttgtatcgcccaccaggctgcacaccgtgcactgccttagcggacatagcttagttggtaaagcgcgaccttgccaaggtcgagaccgcgggttcgagtcccgttgtccgctctctttttctcactgttccagacggtttatgccaactcccctgcgcattggcacatggcagaattccggcactttgtaccacttcaccgtgtatccagcgccatgcgcgcagaacaccgagtccggcgtatgctccagatcggcctccgggtcgtagcctgccccatccacgaccgtctgctcgtcatggcattccctgtatccgccgaacatcagcgccagacgcccttcgccgtgcgtatatgcgttcacgtccatcgcatagtcgcgcatttcgctcaccggcgccgcgccttccaccacggcaagcccatcctcaatctgcggggccgcgctctcgccgcccatccgctgcacgtcgctcaacgcgcgcccgagcatctcctgcggcaactcaagacggaaccggtaccacggttcgagcagcacggcatgccccgcttcgcgcgcctccatgagcccctgacgcaccgcgcggtatgtcgcctgccggaaatcgccgccttcggtgtgcttcaggtgtccgcgcccgccgatgagcgtcagccgcatgtcggtgatcggcgcgccgatgagcacgcccggatgctcggtctcctgcagatgctgcatgatgagccgctgccaattgcggtcgagctcgtcttcgctcacatcggtggcgaactccaagccactcccccgctcgaggggctcgatcagcacatgcacttccgcataatggcgcaacggttcgaaatgccccacgccttcgccgggcgcggtgatcgtctccgcatacaggatcgaccccgggccgaaggcgatgtcaagaccgaaacggtcatgcatcagctgttcgatgatctccagctgcactgcgcccatgagctgcacatgtgcctcctgcagccgctcctgccacaccacgtgcaggagcggctcctcgtcttcgagctcgcgcaacgcctgcaggcacgcgtgcatatcgttgcccccaggcagcagtgtgtaggtgagcaccggccgcaataccggctgtgccgcattgcgcgccgcgccgagcccttcgccggggaatgtgtgcgccggtccggtgaccgcgcacaccgtgcccgcgggcaccgactcgaccgtggtgaatttcgcgccggagtagacgcgcacttggtccactttctcggcgccgcccgcttcgggcagcatcatcttggcggtgagctcgccaccggtcactttgatccagctcaggcgattgccctgccggtcgtgcgagatcttgaacacgcacgccccgaattcggcagtatagtgcggttcgcgcgtgaaaaacgcaaagccttccacgaactcactgatgccctgcattttgagcgccgagccaaaatacaccggcaccgccgcgccgtcggcgatcaatgcgcgcactgtgcgcacgtcgatgccgcctgtctcgagatattcgtccatcgcggcttcgctctgcatcgcgagcgtgtcgagctgacgttcggacagcgcatccgccgcgccggtgaaatcgatgcacgcgtccgaacagcgcgcgtgcagctgttcgaggatgcgcgcgcggtcggcgcccggcgcatccattttgttgacgaacacgaacacgggcacatggtagcgccgcagcagccgccatagcgtaagtgtatggccctgcacgccgtcggccgcagacaccacgagaatcgcgtagtcgagcgcctgcaacgtgcgctcggtctccgcggaaaaatcgacgtggccgggggtgtcgaggattgtgagctccgcttcgccgacgcgcatcaccgcaggctcggtgtagatggtgatgccgcgcgcgcgttccatcgcatcggtgtcgaggaacgcgtcgccgtggtccacacggcccagtctgcgcgtggtgccagtggcgtacagcagtgcctcggacagcgtggtcttgccggcgtccacatgcgccacgattcccgttacgatccgcttcaccgaagtctcctttccgtgcgcaatgtgcgtcatgccaccccgaacacgccaccgtgcacggtgtagacgagaccgcacacacccaacaccacgataagcgacaatacaacccagcccctatgcgaaaacagctggcgcagtggcacgccagggcggcgctgccggcgcgccaccacgagcagcggcaggccaatcgcatacaacgcgcacgccatcatcagataccgcaggcccgcggagtagacgaggaacagcgagaacagcgtgccgagcacgccggtggcgagcgcacggcggcgggctgccgcactggggaatgccgggggctcacgtacggcgattttccacagatacacgcagcacagcaggtagcatggcatcgccatgaccgaggtgatggagatcatgacatcccaggcgtcgccgttgacgaaatggcagagaatgagcagcagctggcaggtgacggcggtccacaccaggccggtggatggggcgccgaagcggttggtggcgaggaaggacctcgggtagatgccatcgcgcgcggcatacaacggcatctggctgatcatgatcatccagacgagccatgcgaacaccacggagatgatcacgccggcattgaccatgatggagcccccctggccaaagcactgttccatgatcaccgacatcgagggattgggcatccgcgccacctggccggaggaatatacgccgagcggcagcagtgaaacgaggatgtagagcacgagcacggtgagatagccggcggttgtggcacgggagacgtcacgcggatggcgcgccgaaccggagaccacgaccgcgccttccatgccgatgaacagccatagggtgacgagcatggagtcgctcacctgtgcaccgatacggtgcacgtcgaacccgagcggcgtgccttgggcccccagcccccagaacccacgcaggaatacgccggttttgaatacggcggcgagggccaccacgaacacgatgaccgggatgatcttgcacacggtgccggcgacattgatcagtgcacccgttttggtgccgagcaatgccacggcgagcatgagccacagaatcagcgacgagccgattgtcgcggccacattgttgccgttggtgaacgtgccgggcatgaagatgtcgagcgtggacatgatgagcacgccataggccaccaatgagaagcagttgcacagccaatacccgtaggccacaagaaagccgacgaaatcgccgaatccgctgcgcgcgtaggagtacaggccgtcttgcatatggggtttgacgtgggtgagcacacggaacgtgttgacgatgaaccacatgcccacgccggtgatcgcccatgccacgatctggcctccggcggacgcatgctgtgccatgttctgcggcaggctgaagatgccgccgccgaccatcgccgacaccacaagcgcgaacaggccgacgaaccccactgtgctgcgcggccccgcggccgccgcaccggaaccctccaccatcgccggcgcattggatgcgtgttgcccgctgtccgccatcgtcaatccactcctgttgtgtgcatgcatgccgacatcagagcgtaacagatagttcgttccgcccggccggttgtgcgcccggcgcaatgtgccatggtgtcacacccaaccgcgcaccgcgtagaagcgcagtgtgcacagcacatccacgaggatgtcgttgagcggcccggcggtgtagtcgaccatggcgtaggacgcatacccgtcttcgagacgccatatcgtggcgcatgaaaacccgttggctgccgtgccatggaaccgcagcaaggccgcgttcggcgccgcgtgtgcatctgcgctgtgcagttcgaacgcgcaggggtcttccgcgctcgcggccacacgcaccggcggtgcaattccgagctgagattcaggcagcacaatgggcgcgatccgcacgatgcgctgttcgagtagatcaacagtcacggcaggcggattgccgacggtgccgatgaggtcccggtaggcgtaggcgatgcgccgtgcggctgacgcagaaggcgtgtccgcgcgcatcgtcgtcaggatgcgctgcgactttggcgcgtcggccgcttgctcgatgaatgtggcggtcaggccttcggcgtcatagtcgcagtcgagcgtgaccacgtgcccatggttcgcgcgtgcttgcatgtgcagtcgagcgtggtcatccggaccgtcgcacaggcgcatcagtgcggcggtgagttcgttttctgaaggcatgcactccatataacagtatcccgcctccaaacgaggcgggatactgttgcaatataattccccatgtgaattacacggtgtggggccgtatgactcacacgcttatggtttcctcaccaatgggaacaatatatggggaatcgatcagccttccttggcttcggcttcacgttcaatggctttgtccacattggctgcggccttgtcaaggtccacgtccgacttggcgtcgtgcttggcggccctttcgacgtccttgatcgcatccttctcctgatgctcggccttatgcacgtccacatcggccttaaagtcatcgaacctctctttgagcgtttcgtggggcttcttttcgtctgccataacgaccacctttcgtgtgagtagtctgtagcccatctgggcctatccccattacaccgcatcccgcatctcgccgtgccaagcgacgctacaagcgtatattcgaccgtcattttttggcgattccgcatggcattggcttgcacgccaaaacacgatggcaacatgcattattcccgttttccgcgcagcaccgaagcccctatgcatatggggaacgcggtgttaggttgagggcaggcgcgcaaagagacgcgccgaacatccatcacaaccatacgcaagtcccgaggtgccattgtgttccatccccgtttttcacacccgtccgcacacgtcaccgccgcggtcgcttccatcgcggcgctcggcatgctgctggccggctgcggcaccagcggcggcaccggctcccccagcgcgcaaggctcatcaagcaccgcaaccacttcggtgatcacggtgaacaacgtggaaccctccgccaacctcttgcccggcaacaccaacgacatggccagctggaaggtcgtgacccagctgttcgaaggactcgtcacgttctcggacgacggcgaattgatctacgccgaagccgaatcgattaccccgaacagcgatgcctcacagtacacgatcacactgcgcgacggtctgcggttctccgacggccagaagatcaccgcgcagacctatgccaaggcgtggtcgttcgccgcgaacgccgcgaacgggcagctcggcgccgcgatcttctccacgatccaaggctatgacgcgctgcaagacaccaatggcggcaacgacgcgcaattgagcggactcaaggtggtggacgaccacaccctgcaggtcacgctcaacgcgcccgactcctccttcccctacaaagtgggcgacgtggcgttcctgcccatccccgaaagcgcatacgccgacgccaacgcgttcggcgaacacccgatcggcaacggtccctacatgctcaagcaatggaaccatgattcgagcatccagcttgtgccgaacccgaaatacaccggaccgcgcacacccaagaacggcggcgtcaccttcgagctctataccgacgtgcaaaccgcgtatgcggatgtggaatcaggcaatctcgacgtgatcgacaccatccccacctccgcgctcgccacataccagcacgaaaacggcatccaggccttcaacaagccgggtccggcgttccgttcgttcaccattccgcagaagctcaagcatttctccggggaggaaggacgcctgcgtcgcgccgcgatcagccatgccgtgaaccgcgccaacatcatcgagaaggtgatgtacggcaccgcgaccgtggccaccgatttcaccgcgccgacgatcgccggttattccaaaagcctcaaaggcgccgacgtgctcgactacaacaccgaaaccgccaggaaactatggagccaggccgatgcaatcagcccgtggagcggcacgttccgcctcgcctacagcgcggacagcggcgacaagcagcgcgtggagggcatcacgaactccatcaagaacgccttgggcatcgacgcgcagccatacatcatccccacgcagaaggagctgagcagcgcgatccacgaccgcacgatcaacgcggcattcctgcagggcctgcagtccgactacccatatccggaaggctacctgatgcaggcctacgattcgtcagcggccgacggcaagggcctgaacaacggcgattacaagagcacggccttcgacaaactgatcgatgacgccgcgcgccaaaccaacgtggatgatgcgatcagctactatcatcaggctgaagaggtgctgttcaaggatctgccggtgattccgctgtggtatgcgaatgtgaccgcggcggccggcgagcatgtgcagcatgtcggattcaattacatgggcgtaccgaagtacaacgaaatcacgaagtgatggcatatgggagcaattgcgaacgatgagatgatcaccgccaaagacggtcaacagcacagttggaaatcggtcaaattgctcatcgccacgctgattgtcagcacgctcggcgacggcttctgcggtgtgatgatggcggtcgcgctcccgaacatctcggaaacctaccatgtgagcatcgccacagccaactgggtgacggttggctatgcgatcgtcgcggccacggcggtgatgaccgccgccactgtgctcgcgcgcatcggcttgaagaaactgttcttctggagccgcgtgctgctcatcgtcagttcgctcattggcctgttctccctgaattttccgatgatgctcacgagccgcctgatccaggcggttgggtcgggactcatgttcccaacaatcaacacggtgatcatccgtgtggtaccagccaagatctctggccgtgtggtgtcgctcaacagcgccatcatcggtctgggcatcgcggtggcgccgttgctcagtggcgtgttcctgacctatgtgagcctgacgtcgatgtatgtggtgccgttggcggtcggcatcatctcgatcctcatgggcgcgaagttcatgttcgacgtcgaaccgcgcaagcagcatccgatcgacgtgctgtcgatcgtgctctcgttcgtgggcttggccgcgctgatgatgggcttctctgagctgacgcaccgcccgctgttcgccgtgccgatgctcatcgccggtgtggcggtacttgtctggttcgcggtgcgccaattccatttggatgtgccattgctcgacctgcacccgatgaagcatctgtatgtctcgcttggtgtgctcatgtatatggccggcgcgatgggccagcaggccgtgttgttgctgttgccgctgtacttggagcgcgcgtgcgattacacgccgttcgtggccggctgtttcctgctcatcatgacgttgttctattcgggttcggtgattgtgggaggcaagaccgtggaccgttccggcatgtggccggtcgtctcgagcggcttcctgctcatggtcatcggcctgttcgccacgttcttcgcggcccccaccaagatcgcgtggctcgtggtgctcatcggatccgttgtggttgtcggcgacgcgctcatcaacgtgcccgacaaggatgtggtgcttgaggcgctgcccgacaatacggtgcccgacacgagcgcgatcttctcgaccggcaaccagatcgcgggttcgatcgggtcagcgctgttcgtcggcgtgctttccgccgatgtactcaggcagaccgcggaaggcgtcaaccgccatgccgcatacgcgaacggcttccagcattcgatcctcatcgccgcgatcttcgaggtggccatgttgcttgtgtcggtatggtattcacgcgagatggtgaggcacggccgcgccaagatcaaccagacagcctaaccggccagccagaggctccgccacggaggtacaaggaatgccgggacccgtatcgagggtcccggcattcgcatatgcggcatccttatgcggacggcgcatcccttcagtcgctggcggcctcctgctgctcttccacgccgacctcggccttgaggcgggccagctcatcgtccaccgatgcggagccgccggcaaggtacttgttggcgatgtcttcgttgcttgcctgcgtgttgagctcagccgtggcgttggcctcattgagcatgcggtcggccttctcctccatgcgctcgaacgcggcggtgccacgggaggccttggcggtcttctcggtggcttcgttgacgtgctgctgcgcgttggccacggagaccttggcgtgcaccgcggcacggcgtgcctgcaggctgttgatgtcgttgaccagcttgtcgtgcatctgacgcatcttcgccgcattgtcttcggcgacggtggcggcggtctcgagtgaagtgagcgtgctctcatactgctgcttggtggcgagcagtttgcgggcatcgtcgtcgttgccggccttgaccgcggccttcgcggccgcctcgtacttggcgatgtccgccttgcagtcgttgacctgctggcgtgcgttggtggccgcggccatgacgctcgcggtctccttcttgaccgacgcgaggtcttcgttgaggtcaagcagcatctggtcgaccatcttcgccggatcctcggccttgtcgagcagcgcattgatgtttgcgcgcatgatgtcgccgaatcgtttgagaatagccatggctattgtcctttctgttcctgaccaacctgatcgttgtgatctgcctgatcatatttttccaaaatcggatcgcgcgcctcttcgagcggtgtggtgaccatacgctccacatactgctcgtgctcgcgtttgcgtttgatgagcatccatgtgatcacggcgccaatggcaagcatgccgatcacaatgactgcgatgatcacccacttgtgcacatcgttcttcgtggtcgtcttggtcatgatgcggtccgcagtcgaatcgaacgtggccacgatcgcgtcatcggtggaccggtcgctgtaccagtactcatcaaggtacgtccagaatatctcagtggcctgggcgtccatgatgctcgagacgtgcttgccgttgacgagcgtcatatacccaacgtcgttgtccacgtcctgctcggcgaaatacacaaacagcagcgtgtcctcattgtcgatgtggtcgtcgtaccattcgcgcgcccatgcctgtttctcatcatcggtcttcagctgcggattgtatttggcgaacaggatgtacggctgtatgccggtcttgtcgtagaacaccttgaggcgtttcgccgcggatgtgcggttctcgaaccagccgagctggtcgtcgatgcagttcgaatcgtacggcagccctgaatcgagcttggtgcggttgtacgtgctttccggcaccgtcacgttgtaatcattgcggttgggctcattgttcgagcagctgggcatcatgaaaatgagcaggaagatgacgagcgcggccaggatgccgatcagtggcatgagtccggtgagccctccattgggctttttcccgccgttgttgttgcctccgaacggcgtttgcatggtgggcggggccaccggcggcccaccggccggcgagaacggcccttgccccgcgcccggcgcacccgtgccgaaggggcctgccgaatatggaccgggcgtctgctggcggccgtagttcggctgctgccccatcgcgtcgaagatctcttcagggaatggcatgctgcgacggccgtagcggttgcgggtggaacgccgccctgcgttgtagccacctgccatgcctatgccggccgcccggaacagatcgcccacatcgaatccgcccgagccagtggacccgctggactgcgggaatccggccgagccaccgcccccggcgcgccggcccgaacccggcatgctcggccgatgcccgctggacatgcgtgaaccaccgtcgtggccgcttgacgatcggccagaccctgaaccggcaccagctcttggcatgtgaacatcctaacctcgttgtgagtattggtatcaatatagccgatgtgccggcaggctgcccggttgtctcatcgttttattgcgcacaatgaacatggttgccctatacatgctcagtgtgcacgcactccacgccggcgttttcgcgcggcggcgcaccacgatcgccacggcgatcgcaagcgcgaacacggagcccccccccgcatgcgcggtccgtgtgaagttcatacctgcctcaaacagacccacatatctcgcgcgtcgggtttcacgcatgtcgcgaagtttctcataccgcacgccatcgaactcgtaacccatcgttgcaacctccaaatctcgagggtgttacaacaatcactagaattcacctcttcctcatcgaaagcgccataatcgagagaatccaagtctgtgcttgctacccctcatcataagcaaaaaataatcctcattttcccctctgcaggtgaacgaaaaacgacaccggtgcgtcgcacttttttcgtgcgtcgcaccggcgtcatcgagccctgtgggcaggtggtcagtggatcacgccttggccacatgcaccccgagggcgtcgccttgctcaacctgcatcgacgtggacagcgtctccgagcagatcaggtcgcggaactgctccaccttcggcaggtcaccggaaggcaccgtgagcgtgagcgcgatgcggtcggacacctcgaggccggcctccttgcgcgcatcctgcaccgcgcggaccacgtctcgcgcatagccttcggcgatcaggtcaccggtgagctccagatcgaggatcacgaatccaccactgggcaggatcgacgatgcggaatcgcgccgtgccgtggcgtccgcctcttccacgcgtcgggtgatgtcgtattcgtcgccctgcagcgtgatctcgccgttcggcgtctcgatcaccgggtcgccggttacagggtcggcatgccagtcaccgctcttcgacgccttgatcgcgaactgcacctgcttgcccaggcgagggccggcggcacgcgcattcaccttgagctcgtcgatgatcttcagaccatgctcggcggcctcatccagcgtcgaatagtcgatcgccttgatgttgagctcgctcttgagcaacgcgtcatatccatcgacctgcgaaggatcgtcgacgaccacggtgagcttggcgagcggctggcgcacgcgcatcttatgcgccttgcgcagcgacagcgtggacgaaacgatctcgcgcaccttgtccatcgcctcgaccagcgcgccgtcttcaacgagcaccttgccgagcgcggtatccacaccggtctgcggatcagtcagatacggccagtcacccaagtgcaccgagtcaccgccggtcagaccacgccacacggcctccgcctccatcggggcgagcggggcaagcacgcgcatgaacgcctcaagcaccgtatacaacgtgttgaacgcgttctcatcctcgttccagaagcggtcgcgggtattgcgaatgtaccaattcgtgagcatgtcgatgaaatccgccacctcgtcgcaggcatcggaaatctcgaagttgtccatatgctcggtcacgttcgcaatgagtttgcgcgtgcgggcgagcagatagcggtccatctgcggcagaccgggcacctcgtcggcacgcagcgtgcgcgcgtcatagccatcgccgtggttcgccgcattggcatacagcgtgaagaagtaatacgagctccacaccggcagcatgatctggcgcaccgtgtcgcgaatgccgtcctccgtcacgatgaggttgccgccacgcagaatcggcgagctcatcaggaaccagcgcatcgcgtcggaaccatacttgtcgaacacgccgttcacatccgggtagttgcgcagatgcttgctcatcttctgaccgtcgtctccgagcacaatgccatggcagatcacgttcttgaacgccggcttgtcgaacagcgcggtcgccatgacatgcagcaggtagaaccaaccacgggtctggccaatgtattcgacaatgaagtcgctcgggaagtggtgctcgaagtactccttgttctcgaacgggtagtggtactgcgcgaacggcatggaaccggactcgaaccagcagtcgagcacatcggtgatgcggtgcatcgtggacttgccggtcgggtcgtccgggttcgggcgcgtgagattgtcgatccacgggcggtgcatgttgatgttgccgtccttgtcacgcgggtagtcgccgaagtcacgcttgagctcgtcgagcgaaccgtacacgtccacacgcgggtacttcgggtcgtcactcacccacaccgggattggcgaaccccagaaccggttgcgcgagatcgaccagtcgcgcgcattggcgagccacttgccgaactggccgtccttcacgttctccggaatccagttgatctgctgattgagttcgagcaggcgcggcttgatcttggtcacgctcacgaaccagctggagaccggcttgtagatgagcggtgtgccgcaacgccagcagtgcgggtaggagtgcacgtagctcttctcctggaacagcaacgcgcgctcggactccggacgctcggcgagcggaccgtcaccggcgcgcagattgcgcaggatcggcagattcgcatcgaacacgaacatgccttcgtagtccgggcacagcgacgtgaagcggcagccagagtcgagcacatcgacgctcgcgatgccgtgggcgttgagcgtgttcatatcgtcttcgccgtatggtgcctgatgcaccaagccggtgccttccgtggtgtcgacgtaatcggcggtcaggatctggtaggcgttcggaccgggggtgccgccttcggccgtggcctgctcgcccgcgaaatacgggaagaccgggtagtagcgccagcccaccatgtcggagcccttgagctcgcgcaccacctcatagtcctcgccgagctccttgttgtaggaaccgagcaaggccttggcgaagtagaacttcttgccggcgaacttgccttccttggggcgcacctccacgtaatcgatgtcggcgcccaccacaatcgcgaagttcgtgggcacggtccacggagtggtggtccagaacaccgcgtaggcgtcgtcttcgtcacgcagcttcaccgcgaccgaaacggtcgtgtcctgacggtcctggtacacgtcggcgtccatgcgcagctcgtgcgcggacagcggcgtctggtccttcgggcagtacggcagcacgcggtagcccttgtatgccaggcctttctcgtacagcgtcttgaacgcccacatgaccgactccatgtacgggatgtcgagtgtcttgtagccgtgttcaaaatcgacccagcgcgcctggcggtgcacatagtcacgccattcgttcacgtatttgagcacggaggcgcggcaggcgtcgttgaatttgtcgatgcccatctgctcgatctggtcgaccgagtcgatgccgagctccttctgcgcttcaagttcggcgggcaggccgtgcgtgtcccagccgaacacgcggttgacgcgccggcccttcatggtctggtagcgcggcaccacgtctttggcgtagccggtgagcagatggccgtagtgcggcagtccgttcgcaaagggcgggccgtcgaagaacacgaactcattcgagctgtgctcaccactggggttttcgtcgatggatttctggaaggtgccgttggtgtcccaataacgcagcacatcttgttcgagctgcgggaagtcgggattcggcgcgacgttcgcgctttgttcgccgaccgatgccttgggatacacgtgctgtggtgtttcgctcaccattgctcctcatcttgcaggatctgtcttttcctgcgaggacgatggctccgggcggattgcttgccaacccccgcgccaccgcggtaccacctcgcttgccacgcgggcgtgcatgcacgcgtgaccgcttgtgttcggctgtacgggccgaccccgtcggttctactgggtcgggcggcgccccgcccggctgttcttccgaaggctccccgctgatgacggatcactgcctggtttcttgcgccactataccagcaacgcgggaacgaatgcgaccccgaaacacgaatgacccaccccggcacgccttccgttcgactcacacaccctcacgcatgcggcgtggtgtgccctggggaatggggcggctcgatgggcgggccattgcaggggaacacgaatgatggttggtctggtgttcgcggcactatgtgccatcggtcactcggggacttccatgtgctgccaggtgtccgcggactcgaacagcaggtctttctcgttctgttcggcgaccttgtgcttgtgggcggttgcacaaccctcggcgtccacttccggctcgccggttgccggatcggcctgcggcttgtccgtttcgctgaccacctcttgaagttcttcgacttgtgcggcgtcgagtcccttgagtccttccgctttcttgggttcggtttctccttaacaatcgactctcgtcgtcgatgacgatatgctcactatagcgtcttttccactgccccacgcgcagcgtctcacgttttcccaatcagcacaacaccataagcgcttcagttacttgcgtcatcggtgaggtagaaatcgcgcagtgcacgcaggtcggcctcactgagcccaatcgccgtacgcaggtagccgacggggccgccgaacgatgcagtggcgtcgatatacgtctggaaatagagcggcgaggcgacgaggaactcgtcgatgtccgcatgggccttggggccgagcagtgcttcgaaggtgtcgacgaacgccggcatttccgtggacatgtagaggttggtctgcaggtaatcgtcgcggatcacgtcttcaggcacttccagcgcggccagaatgagtgccgccgcgatgccggtgcgatccttgccctgtgtgcagtggaacaggtagccgcccggctcgtcgatgagcaggcggaacatccgcttccagcacgcgaccgcggcgtcgtcgagcacgaggcgcgggtagaggtcctcgatgaacgtgcccgggcgggtgacgatgtcgcgcagctgcaaacgcagcgccttcgtctcgcggaacgtgggcagtgcgtagaacgaccaatcctcgagcaagcggtctggcttcaggtcgcgttcgggatcggtgcgcaaatcgatgacgttcgagatgcccctatgcgccagcgtctccaggtcgtcatggcgcgcatcgtgcaggttcgccgagcgcaccagcagtcccgggcgcaccatgcgcccttgctccgtgtggatgccgcccagatcgcggcagttctccacggtgggcaacggcagtttgcgtgacactacgcgcatagggctcctctcaggtgggtcagcgactcacttgtcttcgagatacgggtcttcccactggttttcgttgtcggtctcctcggggcggtcgattgcgagctcctcgcgttgcgccgcatcctgcttggcttccttggaggcatcgctcacacccacctcgttttccggaatgtcctcattcggcttgccggtgatcgggtcggtgtacggatggtcagtgtcgctgacaatctgctccatctgcttgacctgatcggcgctcaccgcgccaaggccttcgtgtgtgttggtgtctggaatgttctgttgctctgccatgatggctccaatctcgagagcggcgcgggtgcgtgtcgccccgcttcctatccccccactatagcctcgtacaaaaggggcgcccggcggactttgcccagtggggaacatgcgtgcaggcccagcgtataaggaagccccttgcctatgtgtggcaaggggcttcgtacgtacgccggtgtcgattcgcccggcatgcactcccctgctggggcgcatgcgcgggcggttcggcggatcagtgggtctggtgggtctcttcgtgctcggcgacttccttcttgtcgcccttttccgcacgggaggtctcccagccttccttgacgtccttgagcttgtcggtcagatcgccgacgctcttcttgatgtcttcgaaatcatccttgtgctcgtcgatgcgggccttgatctcttcgaagttctccttcatcttgtcgctcatatcaaccatggtgaccttcctttactggtaaacgggttgcctgctatccattacagcacgttggggccggttgcgcagatagggaaatcgccgcgcgcggcgtcccgcacataccaaagcgcggccgtgcattgcacacggccgcgctttcgctttaccggggcccgctactcgagttcgagcgagccagtgtacagctggtagtattcgcccttttcctccatgagctcgtcgtgcgagccgcgttcgatgatgcggccgtggtcgagcaccatgatgacatccgagttcctgaccgtggacaggcggtgggcgatgacgaacaccgtgcgtcccttcatcaggttgtccatgccggcctggaccacttcctcggtgcgcgtgtcgatcgacgatgtcgcctcgtcgaggatgagcgctggcggatcggcgactgcagcgcgcgcaatcgagatgagctggcgctggccttgcgacaggccggagccatcgccggagagcaccgtctggtagccgtcgggcagcatgcggatgaacgagtccgcattgacgagcttcgccgcggcgatgcattcgtcatcggtcgcgtcgagcttgccatagcggatgttgtccatcaccgtgccggtgaacaggttgacgtcctgcagcacgatgccgagcgaacgcctcaggtccggcttcctgatgcccttgacgttgatgccgtcgtagaggatcatgccttcctggatgtcgtagaagcggttgatgaggttcgtgatcgtcgtcttgccggcgccggtcgcgcccacaagcgcgatcttctggccaggcttcgcgaaccacgtgatgtcatgcagcactggcttgtccgggttgtatccgaaggtcacgtcggtgaagcgcacgtcgccgcgcagcagcgtaagcctgccgtcggccgacgtgaccgcctcttcatgcgcctcctcggccacttcggccgcgcgcttgctgagcctcttcgcggcttcgcgcgaacgcgtgccgtcgtcgctcgcctcgcgcttccacgcccagtgaccggtcttcttcggcgtctccgtcatcgtacggccgtccgacgcgagctcgacgttgacgagcgtgaccgtgccattgtcttgctcggacggctcgtccatcagcgcgaagatgcgcgaggcgccggcgagcgccatcatgaccatcgtcatctgctgcgagacctggccgatcgggttcacgaaggaccgcgacagcgtgagcagcgagatgatcgtgccaatcgtgaacgcggctccggagaagctcaggttgccccaattgccaagcgcggcgaggccgccgaagatcgcggagagcacatagagcagatagcccatgttgccgacgaccggcatcagcacgttgccgtaggtgttcgcgctcgcgctggcgtggtacaggcgctcgttgcggtcgtcgaacgacgcctgtgtggcgtcctcgtggttgaagaccttgatgaccttctgcccgttgaccgactcctcgacgaaggcgttcacgtcgccgagctcctgctgctgcaccacgaagtagcggcccgaacggctcacaatcacgcggatgagcagcaggagcagaccggtgaacacaaggacgaagaccgtgtagggaatcgacaggtagagcatcgcgatgagcgccgcaagcgcggacacaccggatgcgaacatctgcggcagcgactggctgatcgcctggcgtagcgtgtcggtgtcgttcgtgtaccggctcatcacgtcgccatgctcatgcgtgtcgaagtacgagatcggcagtgtctgcatgtgttcgaacatctcgtctcgaatctccttcatgacgccctgttcgacgccgacgagcagatacgagtacagccacgcgctgaatgtgccgagcgcgtagaggatgcccatgaagatgagcgcttggatgagcggcgcccagtccgggacgctctcccctacaagcggcatgatataccggtcgatcaacgcctgcaggaacaatgccgaccccgcctgcgcgactgcggacacgatgatcgcgatgatgatgaccaccatgcgcaccttgtatgtgaacacgtatttgagcagtcgcttgagggtgcccttcttcgccttctcacgcggcatgccttgcgcgccgttcgcctcgggcatgcgcgcgtcgtcattgagggtctctttgtcggtggcagaagtctgtgccaccgttgccgccgctgcgctcatcgttgttcacctcccttgattgcttcgatgtcttgcgccatatgcgcttgctgctcgcgttcgcgctccttctgccgcgcgatgacgtcgcttgtgcgcatgtcttcgttgtagtcggtcgcgaaaccgctcgcctcggcctcttcctcgtgcaggtcctgcgattccttgtcgaggtcctgttggctgtgctgctgcgtctgcgattcgtagatgctgcggtattcctcgcaacgctcgagcaattccgcgttcgtgccctggtcgaggatgcggccttcgtgcatgacgacgatcttgtcggattcctcgacggacgcgacgcgctgcgcgatgatgatcttcgtggtgttcgggatctcgtggtggaacgcttcgcggatgagcttgtccgtcttggtgtccaccgctgacgtcgaatcgtcgaggatcaggatcttcggcttcttgagcagtgcgcgcgcgatgcacaggcgctgccgctggccgccggagacattcgtgccgccctgctcgatgtacgtgttgtacttgtcggggaattcctggatgaatccgtcggcctgcgcgagttcgcatgcatggcgaatctcctcgtcggtcgcgtacggattgccccagcgcagattttccgcgatcgtgcccgcgaacagcacgttcttctgcaacaccatcgcgacctcatcgcgcaacgcttcgagttcgtagtcacgcacgtcgacgccgcccactttgagcgcgccggaggagacatcgtacaggcgcgggatgagctgcacaagcgacgtcttcgcggaaccggtgccgccgacgatgccgatcgtctgccccgaacggatgtgcaggtcgatgtcatcgagcaccgggcgttcagagtgttcggaatagcggaacgacacatggtcgaagtcgatcgagccgtcggccacggtcgtgatgggctcgtccgcctcgcggatcgtgctctcctcggtgagcacgccacagatacgttccgcggatgcgcgcgagatgatgaccatgacgaaaatcatcgagagcatcatcatcgccatcatgatctgcatcgcgtacgtcacgagcgcggtcaggtcgcccgtcgtcaagccgagcgcggcgttgttgccggacgcgacgatctggcgcgcgccgacccatgcgatcgcgatgagcgacgcgtacatgcacaggttgaacagcggcgagttgatcgacaacagcttctccgccttgcagaactgctcgtagatcttgagcgagatgcggccgaacttcttgccttcgaaatcctcacgattgaaggacttgacgacgcgcacgccctgcaggttctcgtcgacgacgttgttgagctcatcgtacgtgtggaagacgcgttcgaagatcgggtgcacgacgatgatcaggccgaacaggccgaccgcgagcacagggatgcacgcgaggaacaccatggagatctgcgggctgatgcggaacgcgaagatccatgcgacgatgagcatgatcggcgcgcgcatgccgacgcggatgagcatctggtacgcgttctgcacgttcgtcacgtcggtcgtgagcctggtgatgatcgagcccgtcgaaaaacggtcgatgttcgcgaagctgaactgctgcaccttctcgaactcgtcatggcgcaggttcttggcaaaaccggaggaaccgatggccgcgaaccgaccggacaggaagcccgcgcacaacgacacgaccgcgcaggcgatcaggatgccgccgtacttccagatgtccggcatggatttgccgctgatgcccttatcgataagaatcgcgatgacggtggggatggcgatctctatgaccgcctcaacaatgacgaatagcggcgaaagcaggctcgccgtgcggtattcccgaagggacttcgccaatgtcctgatgacatgcgccttggatggcgtggtgtcagttgccgtggtagtgctcatgctgcctcatctcctttctgctgctggtgtgtggcgtcttgcctggtacgtgtggccggctcaaccgccgtgcgctcggagccgacaagcccggtctccaccaaattggcacgcatgcgggcaaggtcgtccatgaaccgttcctgctcgtccggggtgaatccagtgaacagcgtcgtctccaactggtgcgcggcgcgcatgatctccacaacaaggtcggacgcggtgggcgtgagctcgatcttgcgcacgcgcgcatcccaatcgacggcggaacgcgtgatcagccccttcttttccatgagtccgagcactcgcgacgcggtggagcgagtgatggagaacgcccgttcgatgtcgtattggaacacatccgaatcgcggtgttcgtgcagatactgcacgatgggcatgttggcgcccgacatcatggagtccgggggcacaatgccgttccaataccggccgatgagattgtggagcgccttgatttcgaggctcgggcgcagcatgcccggcgaattcacaccttgcacccggtccatgcgcgctctcctcttgccgtgatatttcgacgcgggaatattgcgatgccacaacgtcgctactgcaacagaacactatagattgttccgtatacaacagttgcagatacaactagactatgccgacagtgaacccgtgcaacaatcgcgcgtcaccgcctccacatatgcaagcgatccgcgccctacagcacgcaggtcgcggatcgcgcacatgatgggccagtgactactgccgacccgtcacatcagtggattcacttgacttcgttttcggaaacgaaggtcaggaagtcatcggcctgcgtgcgcagcgcctcttgatcggcaccagtcatcgcccagtcgccggtctcgacggcctcgtccggcacggacagaccgacctcgaccgggaagaggcgcatgccggcgtcctccaacagatcgccgaccatgatgcgcggatgcagctcctcgaaaccgccgacaccggaaatcgcgaccggcttctggtcgaggacgttcttgccttcttcatccttcgtggacggcagcgacagccagtcgaacaggttgcgcagcgaatccggaatctccttcttgtactcggagacgacgacccacacggcgtccgcattgcccagcttgtcgcgtacggcgagcgcggcttccggaagcggatactccgggtcttcgccggcgagcggcagatcctcgtaatcaatggtgatcgcttcggcgcggtcgcccacaatgcccatgatctccttcgcgaggtccgcctcgaacgaaccgtcggtgagcgaagtctcaacaaacgcaatagtcggcttgtctgccatgtctcctccttatgccccggccggcggcatggtggtcatgcatggcccggagctgtgaactggtatccatcatggtgcgtcgacgtgtgcggcgcacccggaaatagccacaagtgaacaaagcgcggaagggcgcgcaatggtatgcgcggacgatccactgcccgggcgatactggtggcgtggcacaatccccctcgcacccagagtccccgtacgcgcgcggcacgcgcagctacaccatgtcgcgcatccgcggcaaagacacgtcgatcgagaagacggtgcgctcctatctgttcgcgcgcgggttcagattccgcaaaaacgacaagcggtaccccgggcaccccgacatcgtgctgcccaagtaccgcacaatcgtgtttgtgaacggctgtttctggcacatgcacgaggggtgcgagtcgttccatatgccgaagtcgaatgtggagttctgggcggcgaagctcacgcgcaaccgagaccgcgaccgccggcagcacgagcagctgcggcagatgggatggcgcgtgatcgacgtgtgggaatgcgagctgcgcggcgacgcacgcgaagcgcggctcgagcgacttgtggggcagattgcggaaggggtgtagatttgtgggggctgcgcgcaggtgctaacatctaggcggcaggcgcggattgctgcagtgtcacttccacgcttgaggctatgcgccaatatgtatgttcggttactcgattgccctctctagagcgttgtcgcgcaatctgccccgtcacgaagttcagtgatggctgttggcgtctgagctcacccatgaaaacccgtaggagtcgccggagatggtagttgatggctgaggtcagtcacgggagtccaataatcgcgtcccgcatggctgtcgatgtctgaccatcgacaccaacagccgtgcgggtgacataaacagcgaattcgacatggccgtggtcctgccaccgctacgggtagtaccttcttcgctacgggtagtgctcctcccgctacgggtagtgattcctcgcgtaacctccacctacaatcgttgaaatatggcggatcatagtgacgagtgcgccagaaaagcactacccgtagcagaaagaacactacccgtagcaaaaacagaaactgctgccatcccagaaggcggtaacagacgataagagtggtaggtgcattttgacccggaccagccaattatggcattacgcgaaaagcagcgaaggaagcggttcccaagagccaataacgggttcggaggaaaccgctcaatacgactctacctcaatcaatgggacctaaaccagcaaaagagcgcaaccgttaatcatatggttttcgaatcatccttatgcaggcaggcccgctagcgtccgccatgccaaaacacatagcgactctgcggctcctaaaatgaaatcatgagtactgaagcaacggaaagatcacacatcatccccgcacatgcgggacaaaacagcatgtgacgcgtagcggcgcattccatctcccacagtatgctcggctgcgttcagtgatagacatgatggtcattgatcaaccatgataaaagcattacgatgacaggaggtatgtgggataattgagtcatgtctgtgaaggaatccgatgttgaaatggtgcgtgccgcgaaggccgcgcgcaatacgcgcaatcttgcccttgccctccattccgctgagatggagggcggccatgtatcggatgtgctcctgcatgaagcgcatgattacgcgaatgggctgattgacgccgcgacattgggccttcgcgtatgtgcccggtacggtctgaacgacagataatacataccgatgagcgaaccggtgttcgatccgtatcttgttcctggtacggatttattgcgcaatctttccggtgcgcacacgcaacgggaattggcggagatcgagcattcgcttgtcacggcgaggcactggagctgatggatgatcttcctgtcccagatggcacagtagcgcagttgcgttccatccacaggttcctatcccaggacgtatatgactggccagggagatcagatcatactcaaaatcggccacgcctttcccgccaagagtgattacacccacatgatgtcaatcgtccatccaagtatgcagcacatcactcatagcgacaatggcaccatttccaccgggtatgcatgcacatgaatatccagtacagcgaacacacgtcgagcctcgctcagactcgccaaaccactatcgcgcagcgagtacgcagcctgaatgctgacatgcgcatccttcgccagctgctccatactcaggtgccggtcatccaccgcctcacgcacacggcgtgcgacagcttgcggagttggcagataatccacatgcaccactggacgatgtactgcatcagcatatgccgtcacatcattgtattggctcaaatctaacgtcgtgtgcatgtcagcgcatcctccgcgaatatgatagtacgcaacttttcgtgattcatcttcgatgctagagccgtatgagctgcccgcgcagtaaccagtactcagggctcttcgcctgtgtgccatgccgctggaacaacatgcaatatcgcagaccttgatctcggagccatcggcacaattccgcatacagggctaccgttgaatcggacaaagagtcctgatcaagatggagagcattctcacctacataatccaacgcataggaacgtatgactgaacgatacttcgcaagcgtccaagatttttctgtcaatggaaggacgacatgccagctgggaccgccaccggaatcatgacggatgaaaccagccgtcggacttgtctcgtagtgcactgatcgatacacggggcaattcgagaaaccgaacaatgcacaccaagcacgagcattatcagtcctagaaggtacctttagcccagtgggcgtatggctatcttccgtgcctgcaagttcgtcaacattcgtcaatccaaaaagtcccgagtgcactttctctgcggtacgtgcagttataatcgaggcgagtttgagcaatcgcatcgtcacaaactcatttcccctgttgcgcggagtcatctcccataggctggctccgaatttctgctgaatttcaggcgtagctttggttcgattcaaagaccaatatgatggttctcccaacgctccgatataacgttcatccaaagtcgtccgcaatgaatcaatagcatcacgtcgatctcgttcgagcgctacccattcctcgcgaccggctaccgtaccgatgcgagggctgagcgtagctacagttttccctttacctgcataagagccacgtgcattaagccactgcgacttatgccagcgttcggcatgggcacgcacgatatgagcgcattccatctcggttatttcgtcatttgtctccaccatcagggtgtgccgtccgctccaccacaatctacaaatgcggtcttccacggcatcttcaagtatggacgccaacccaaaaccaagcatgtgtgaaaacgcatcatcgtaatcggcaggaattcgcagaacgctcattaatcatcgtccttccatggatatcgtcacatcagcggcacgaagcaaagtttccagaaaagcgatgccccacaatccgtaacgctcattcgttcgttccatgatgctctgccagtaccctgcatcaaataactcttctgctgcggagcggatggcatgtatggtctgggagccatcgccattctcttcggaaacagtctggatgattgcatctggtatgacctgttgagcattcatcggaaacatggaacgtccatgaccatgagatgtccccgcaagtctagtcaccaattccttgtcatgagcctgcaaagattctgagtcaagagcccagcattcagcggctgaacgttgttcatgccgccatccgtcgagcctcaactcgatgcgcttggcacgttcccaggatgaggaacgatacatacttttggccaatggctcggctggcacattgggcatgcgatatcgtagcaatgtttggaaacgcggatctttcttcccgtcatcatggtgtaatccggcagttcgtatatcagcaacaagtcgggaatcaaagcccagctttgcggcgaatagctctgcgcgtgaccctacggattcctgatggcttcccggaccatcaagcagcacaggaccttggcgattaaaacgcccaatttcctgcaactggtctccatctgctgcatccgaggactgcagcactatgaatactgaagaatcacttgaatcaccgtcgatgaatccatctacgaatgcgattctaaaaccgtgattattaatcgcacaggaattcaacgcctcttgcagatttggatacttcgagacatcaatcccctgatactcggcttcaacagtctcatcagtatcagtttctgcgcgaagcacctcagacagttcctcatatagtgcaggttgtttctctctattcgcatgaaggacagccatcgattgctggcatttgttgaatacatcccccggcgacgttatttcgtcctgaagcttttttgaatgtttatcgtccttgctaaagggatcgagcatgggaatcccctcagaaaacactctggctccgtcatcgacaatgagcacatctcccgagcgcaaggttggatctgaatctgcctgcccatctaaaagatgtacagcattaccgttctcgcttgaattcgtgcgcatgatgaatgctcggcgcccttttaatttgttttgcagagcatccagcattgcatatgatgttaccgggaataattcacgcgaatccggaggtgtggttgccaacagacgctgtgcaagataatcatcctgcggaagagtacggataactaccgcaacatctggcgtgactcgatcagctaagtcatcccttaaccacaagtcaacatccgcaggatacgggcgccctgccgctctatgctcagcaaatacatcttcgctggtatgggacagattctcaacatcccaccattccaaccgctgaagtaccatacgttctaattgcgcaggagcaggcggttgaaggacagatgaccatgccgttagtccctccacaggtagcgattccagccacatctgagcagctgttaggtcttccttcatataggggccacgaatctttccactgttctgacagcatatgacgactggaccttctggtcgcaatcctcgtcgattcactcgaccggcacgttgaacgagagatgcggccggagccaactcactaatcattccactgaagtcagcgtcaatacctgcctcaagtgtctgagtagcaacaacgaacttcagacctgtctgcgtaatcgcagattggtcacctcgaattgcatcatagagaggttccgtggaatccaatcgttgcacgaattgatctcgctcataatcacgcatagggccaacgaatgcacgaactgcattgtcaccggcatccttccccaatgcttccctgagcctcctaactacttcgctggcacgcggaaccgtgttgacgaaacatacgaccaccccaccaaggcgctcctgcaatgcaatgctttccttagccatgcaggtggcgatctgcttgtcatcaactgaaagaacttgtatagggcgcggcgtccgcaatctcctgcgtagctctaaatcgattttgaaatcagcttcctccacaccgcagatgctctgttcatcttgcagattggatatattctcccctgaaggggtggctgttgtcacaacaacttggagaggagagaccggcaatggctcaccttggcgaatacaggcttcaattcttggaatctgttgagcggtgtatgcgaattgtctactcagttgcgcttcatccactacgatgactgcatcataggcaagcaatgcagcctctataggttttgccgcatcgctgacaccatatccgctgaatagcagtcgactgccaatcatgtcaggagtaccacacagtatctggcattcgagcggtttataccgccaaacgcgcatatcagccttatcatcaaggcctccgcgcaagcgttgtgcagagcagacgaccttaccctgttcctgacactggaaagctagctggtcaaacgtccactgtcgatccattagttccgaatactgcctcgcatacagaccgactgcaatgagcttaagaatctcagattccgtgtcatcgtctaatgacgcaacatcgttgatgcgagcgcatgcagccgaggcttccaaatactgatcatccacgatgccacgtcgattgaccgtcactgccatacgtcgtggaacggcatccaatgaaaggcttttcagcagatgattcagttctttcggcaacggaatatcatccaatgcagcgagccctgccaatgcattgacaaagaggtgcacgtcgatgacggcagtcttcccagaaccggtcggtgcggatatcagtttcatccactgtccgttattgacgacttcacgcatcaaacgcgtctgccataaatatggcttacgcccctgatgcaacgattccacgaaaagatcatacagttctacgagcatctcgtttggggttgttgcattcatctccatttcggttgccctttcgttgtgaaacagctttcgggacaatccataggaatgagtaagcccccgccaaagtgcctgctctgcccgatagcgagaatctcatctttaatcacattctcaaatgcaatcaatccggtcgatgccgtaatcatgaagccctcacgcattctgtgcacataatcccccatatctgggcgagccacggtacgcgctgcaagaatacgtacaaaagaatctcctgcagtcactgcatcaatgagatcccagtacttacccctgcctcttttttcggcaatttgcccacggaacacgttccgaaatacgtgccctatggaaaccgcaagattgcattccgcggtccacgacctgctttgtccggcggggcttttttcagcttgtgtttcattgaccgaaaatggcataggtgaccatattcgatgcatgccatcccttggtttactccacagatgcaccccttctccagggattggattccctaatcggagtgcaggcttgctgtgtgaatagtatattctggagttggccaacgaacgtactagcgtacccaatttccgcaattccccagcatccatttcgctgggaatcatcaaaatgaaggcaggaagagactctgcgattctctggtctgcaatcaacgacgcataatctttccgcagaacttgaatggcgatgttattcgccggacgtttaaccatagaatcggtggaccaccgaccggtcagatatggactaacatccgtaccccaacgtcgcactaataagcggtgcaacgccacacaccatgcagtcaattcatcatcccgaggattccacgccgaagcattcgactccacgcgcgcgggaatgataatcatacgagtccatggcagctgtactgccgacttggcttgtttctgagggctgtaggtactgcgatgtacacactgcaatcttttctcagatctgacttctgtgtctttttttgtggatgaatccttcggaatcttagaggctggatgtggattagcctgagtgtaatgctccatcagctcctgatgaagccccggcgcagggcaaggcaattcgcgcgcacgctcgacttccatcaatgattgtgattccggacgcagcatatacgaatcaggaagggggaaatcaaatccctcctcgacagtaatacgtacaggacttccagcgccacccaagaatggaatctcccaacacaaatctgcaattgtactgcactcttcgtcgtctgggccatttttccactcgaggatcatatccccttgttcatcagtacggtacatcacagccgaccgggcccgctccgctttgggagctttgtctgctttacgcctataagcaatggcattatgggaggttggagattgcgaaactatctccggaaaacgaatcgcttccggcggattcgattccaaccattcgagtgctgcgttcaaacgcttgtcaagcataccctgtgaattttcagatgaaaaaacggtatgtgcggctgataccattgcctgatataaacgcatgggagttggaaaagattccttctccccatattcgcttgctccttgataggaagcaagaaggaagtggatacgaatcgcgaacgtcatagcgccatcttccggttatcatctatcatcgtcgtcagcagcgcttgcagattcaatcactgcagggtcgccttgcacagtgataatttgcccatgccaatcaatgcctgcctttttctgagcttgtgcatatgcctgagccaacagctcatcggcgtcttccagcgtaagcatctccaaatcatcatgtttaccgccacgacgatccagaacggttttcggctcatcagcttccacaaggaagcagttttcccgtagatgcaattccgcattgcttccaaccatcgcattgatcaacgctgcagccagcagtacacggatagcttcatcaccctctggccctttaccgaagcgcatagcccgaagcatggagaaactcaggacatgtgtgcgcgtaatactacgaactgcgatgccatcaagagcatttgcatcagttgatgggggaatcgcaccaatgacgatagttgagccatccccgctactcgcgaatttgctgagcttcttgtcattcattgttcctttgatgcgctcagcaattttcttggcttcatttttggttagatgcactccggctgcaactggatcaatacgcgcgcctgcacgatgaattggagactcatgcgtctgatcagcaagcaccgcataaatctcaccgttgaagctggcgggaatacgcagttggttcttgtttcgtgttgagtcccagcacccaaacatcactgtcactggggaaatcgccagcattgcagacaaatcctccaaggaggagtttcgtgccgccatgtacttgactttgtcggattcactgaattcagcgatgcgaatatgcgcgtccaccgcacgatgtggcaattgaacatcatcgaaatacctgacgctgctttcgtctcctgggatcatctcataacgtacgcgaacttggggcatcttactgaaaatcggatggccaacttcaatcgctcggctgatgtagtcttccaaacgattggcctgtgatgttctagaatcaatgagcacagtatcaacacactcatcattcacccagcgcttctcgtacacatacgtcgacccattaccagcagtgtattttgcaggagctacgatactacccatacctgctgccggtgcgagcgacgttacttccgtcagcgcattcgagcccccaatttttgccgcttcattcaagtcttgtactgtgagtttgcgcatcattgctcttttctctacatgttttagtgagatcgattcactactcacacatcgtaccatcatcgttaagcagcaccaaatcagcatgcatacaaagaagctccggggccacaatagccccagagatagatggaatcaaacgagaggtcgatcactacaacatccctcaatgaagctccggagatttgccacgctgaacagcagcacaccgctgcccacgaaaaccattactgcaatatccgcaataacacttcggagaaaacaccatcatacatcctgacacacatcgacataggcgattgtgtaaaaactcacgaatccggcaaatccatcagctacatacatatgtacaccgatacaactcaagatcccgacattctcgttttccctaatcgtttttcacaccaaaccagcactcaaatcactgtcggcactctcacatcttcatagtttcgcgatcctataaaaacaatcgactcagaagtcttcgcatcatccagccgagctataaccaccgaatcttccgcaccattgattaacgtatgaagtcgctcttccatcctcacaagtcttacctcccgcatttccatgagaaaaacgctgtactgcaacctgttcccataactctgcagcagcttggagacacgaatccttcgagaatcatccttgatgtcataagcaatgatgtaccgctgcatcaaattattcatgtaatcaccccttaacgcactcgtattccccgataacgctcaaggctgccctccaatcgccccagcaccatgcgtgcctgtatctccacaatcctgcgccatgatgcccgatatgcataaaccggatgcttcaattccgttgccatccgtcgttcatacgcaccgatcagggtcttacgagtctcatcacgtaaccgcacagagcccatcacattagcgaatccatttcgcttgatttccccattgttcacaaccgtctgcacaacggaatccgcaatgggcgcacgaaattcctccataagatcgagggcaagagccggcttattacgtttactactgtgcagaaaacctgcatgtgcatcaagtccacaagatacaatcgcgcgaatacagtcgctcaacaaaagagagtaggtgtaatccagtaatgcgttaagagggtcaggcgcagggtgtcgcattcgttccaaccatggccactcatttcgcttattcacgctgataagatgatgaaattgcgaaaagtacaacgcagcagcttgcccctccaaacttagaatatcctgtatacgattggcattcaccactgatttctctatatgtttcatatcaaacaaaacattgttgtttttatcggaccgtcggagcaatactatttgattgtgaatttttgccgatatgaactcacgagcaagatccagtcgcccttcgtgcgaagcgacatgttgagcgacacgagtctctccattgggcccataggaagaaaccgaccaacccatcagtcgacctgttccactgcaccagagaatagggatattacgccacatcagctctctcatcaaaccacttgatacatctacattcccgtgtatctggagagcctgaatcgaatccaggggaaccgaggtgatttcatcaccatttttggagacatgcatacgtcctgacttcaagtaggcacgtgcgccaggcgtcgctagatgagtaaccgcatgatccggcactttcaccataatacgatgttccggaatgttatgcgcgcgttcttcaggtagacagatacctgcatgcgagcaacgcatgcaccgcggatcatcctcaaaaggcaatggagctgtttcacactcaataagcttacgaacctcctgcacggaaccgtaagcctcctcgtaatcggattttcttagttcaacaggaacaatccgatggtgcgaggtaaagaatatttcagtcccatctactcgataacccatatcctccatgcatgcagcctgcaaggcgagctgtatacgcatggcatgtgtcacatccatactcctacgcacgggtgtagctttatattcacggataatcacaccgttgtcttcattcaaccggaccgcatctaatcgccccgacagtccccacccctgatgattcacattaactgccctatagtcagtatccccgcggccaccgttggcgtcatccactgcacgatggtcatgaaaaccgcgctccatctgtaacgactcaatcttctcaccttggatttctaaccatgcccttcgtggacaaaagataaagtcacatatgagactaatcggtaatgtatcttccaacccttcacctcgcttcattgcgttattctcagcatacttcatttttgcttagataaaaatcggagtacattcctcaatgaagctccgaagccaaaacttcggagatgcctcctgatggatctccacgacgttgctggcccttcctcaatgaagctccgaagccgagacttcggagatgccatcccgactgtggcggcggcgttcggtgtcgcccctcaatgaagctccgaagccgagacttcggagatgacagtgcgaacacagtgcagtcggtgacgatcgcgccctcaatgaagctccgaagccgagacttcggagattcggtcttcttgagctggtcggtgagtgtcttgagcccctcaatgaagctccgaagccgagacttcggagatgcaacgccttcgttcgcctcgtggactatcgcggccccctcaatgaagctccgaagccgagacttcggagatcaggttctcgaggatgctcactatttccgtgaggatgatccctcaatgaagctccgaagccgagacttcggagatctatacccgtatgcaatgctgtgcgcgttggatgcaagccctcaatgaagctccgaagccgagacttcggagattggcgcgagcagtatcaccacgtggctgctcaaccgccctcaatgaagctccgaagccgagacttcggagataacggttcgatggttcgcacagtgagttgttcactcccctcaatgaagctccgaagccgagacttcggagatttcgtctcctccctgcgccgctgattgacctgtttccctcaatgaagctccgaagccgagacttcggagatgtgatcccacgtgacgaatcatgggccgagggattccctcaatgaagctccgaagccgagacttcggagatgtctcatcagcggcgccacgggtatcaatctcaatccctcaatgaagctccgaagccgagacttcggagatccattccaccgtttcggcgtattcgcaccaccagtgccctcaatgaagctccgaagccgagacttcggagatatttcaggcggcatcagaccttgcggctgggattccctcaatgaagctccgaagccgagacttcggagatgcgtgtggtggaaaaaccagcccgtcaccgaagcggccccctcaatgaagctccgaagccgagacttcggagattcgcaggtgaatatcggtggcggcggcttgtcgtccctcaatgaagctccgaagccgagacttcggagatcggatagtatcctgcgtcgcgtctccaatggcgaccctcaatgaagctccgaagccgagacttcggagatctgacagcatcctctcattcctctcgaacggcgaatacccctcaatgaagctccgaagccgagacttcggagattgttcgctttgatgcgtgtgattgagttcggacttccctcaatgaagctccgaagccgagacttcggagatttcggcgcgtgttcctccgccgttgccgttgtggtgggcccctcaatgaagctccgaagccgagacttcggagatgaggtcatggtgaagtcgcgttcggtgccggtcttccctcaatgaagctccgaagccgagacttcggagatccgcctcccactccgccacgctgagcgccatatcgtcccctcaatgaagctccgaagccgagacttcggagatagtagccataatacagactgatacacatagtctgataagcgcttttgcgagaggtagacaaattgacgtgatacaaacgactgatttatctacacaaactcaacaaatccttacaaagtattgatgcgagagattccccgctttatgctgcatgatgcagccctcgcacgggatagctcctacccctgccgcacctccggccacttcgcgtcgcccggcacgtctgcgagcgcatcgcccacacccagcacctcggcccagtagtccatcggctggtcgtagggcttcgcgtctcccccgcgcgcctgcagcacggcctttgcggcgtgcacgtcttcgccggtcagtccgctgaagtacgattcgaggctggttcggcgctccacatcgtagaacaggttgctcacgatctgcgtgagcagttccgcgcgctcgattggcagtgagtcccagtgccgcatctcgatgaagttcttcaggcgcacatcgttgaagtgcgtggagagcacatggttgatctcgtacgcgttgagctcgcggtccgggtacaggtcggcggccgtcgtgtagaacgccgtgaactcagtgccgtgcacagacgcgccttccgcttccggcgtgtgggtcaggtcggcgaacatgagcggggtgctcagcacgtcggctgcgtaatcctcccagctgaaccgctcgtcgtacaggcccggcgtcacgttggtgcgctgcacgtcgaggtaatcccacatgcgctggcggcacaacggccacgggttcggcgcaccttcgaaatacggcgtattgcggaagaaccatgcgaggatcgggccgatcgcggtgccgaggcgcatcttgtcgattgcgtcgcgctcgctcgtatagtcgatgctcacctgcgtggaggcggatgcgcgcatcatgcacggtccgaactgcccgatgcgccccaagtactcgttcatcgcggcgtaacgcagtttggggttgagtggaatgtccgcgtacgagctcttcggctgatagccgtagttcaccaagcgaaaatcgagttcgtcgaggatcggcgtggcttcgcgcatgaactgcccgtgcagttcgagcagatccttgggtttgcgcaaaatgccgatcgacgtctcgatctgcccgcccggttcgagcgagatggcgattccctcacgcgcgagcccgacgagatgatcgtcctgccagtactcctgcgcggagtcgtagtacgggcgcagacggcgcagcagttcttccacgccgttcggctcaccgtacgtgaccgccgtgtcgtcggcgttgtgcacgggcagatgttcgatctccacgccgaaccccccggtccccggcgcggagcacccctcctcgaagaagcggacaaggctgcgcacgtgccgcgggttcggctgaaccagcaggtgcgcgtaggaaactcgtggtgctgtcataagtgcccatactaacgcgcgcgcatatggacacggcgcgcttgttctaaaaaatccctataacgtgcgcaattcacacactgctgcgtccggctgcggcgttcttcttcgccgcggcgatcatcagtttgatgcgattgagctggttcgcctcactcgcgccggggtcgtagtcgatcgagacgatgttcgcctgcgggtagagccggcggatcttgccgaacatgccacggcccgtgacatggttcggcaggcatgcgaacggctgtgcacagatgatgttggggcagcccgattcgatgagctccacgatctcgcccgtgagcagccagccttcgccggcttgcacgccgatcgaggtgacggtctgcgccttggccacgagctggtccatcggcaggtctttctcgaatttgccgccgctcgattcaagcgcatcgttcacaggtttcatgtaagtgtggatcacacctttgaacgccgtgtacaacgctttgttgcgccccgtgcccagattgtgctcattccagtcgttgatgtacgggcgcatcgtcatgaagtcgatgatgccgggcaccacggcctcgcagtcctgtgactcgatcacttcgacaacgtggttgttggcatcgggctggtatttcaccaggatctcgcccaccacgccgacgcgcaccttgcgttcgacgtcccgcagcggcagcgcgtcgaagctctccacgatcttcgccacgagtttcgcgtacggccagtacgcgcgcccgtacagcatcttcgcggtcttcgacatgccgtggttgagcagtgtctcgcgcacgatcacgttccaccgctcgtacaggcggttcgcggaacccggattcgcctcatacgggcgcacgcggtacaggcacttcatgagcaagtcgccgatgatgagtgatttcgccgcacggtgcagcagcgggacggtgggggtgaacccgggattgtccacgaatccctgcgtggagattgcgatcaccgggatctgcgggtagccggcgtcgacgagcgctttgcgaatcagcgcgaagtagttcgtggcgcggcacatgccgccggtctgcgaaatcgcgagcgcggtgctgtcgggatcataccgccttgatttgatggcttccacgagctggcccacggtcatgatcgccgggtagcaggcgtcgttgttcacatatttgaggccggtttccacgtcggttttgctggcgtgttcgagcacgtcgaatttgtatccggaggcgcgtatggccgcttcgacgagccggaagtggatggggctcatctgcggggccacgatggtgtagtcgcggcgcatgtccttgccgaagggcacgcggttggcgtaggcgctcatggtggcgctttgccggttctgctgggcgccgccggcttgcctccccatgacggcatcgagcaggatttgccggccgggtgtgggcgctgcggtgccggtgtgccggaaggtgccggcgctagctgcgggcgtagcggcgcgctgggcgttgcgttcgcgttcctcgacggcggctttgagtgagcgcaggcggattttggcggcgccgaggttggagacttcgtcgattttgagcatcgtgtagacgtccgctttgtcggcgaggatctcggacacctggtcggtcgtcacggcgtcaaggccgcagccgaacgagttgagttgcacgagttcgagtccgggccaggaggccacgaactgcgcggcgcggtagaggcgcgcgtgataggcccattggttcatcacgcgcagtggcatggtggtgagcttgcggtcgttgacgtgccggaacccttcgctcgtgtgggcggccgggtcggtttcgtcttcggcgagatatgcggtgagcgcgggcacgtcgttggggtcgagccagctgacggagtcttcggagagcacgaccatgccgagcgagcagatcgtctcggggatgccgtggttgacctccgggtcgacatgataggggcgcccggcgagcacgatgccgcgacagttgtgctccttcatgtaggcgagcgcgcgcacgccttcctgctgcacgtcgtgtttgaacacggtgtcttcggcgtaggcggcggcgacggctgcttcggcctcctcgcgcgtcacgccggcccatgcgaattcctcgacgatgcggtcgaccatgaggctgtgcttggagaggttgaagtaggggcgcatgaaccgtatgccgtctgcgcgcagttcgggcatgttggcttcaatgaccaccgggtagttcgccacgaccgggcagttgtagtggttgtcggattctggcaccaggtcgtcttcgaacgagacgcatgggtagaagatcgtgcggatgcctttgttgaggagccacttgatgtgcccgtgcacgagtttcgccggatagcagatgttctcggaggcgatggattcgatgccggtttcgaacagttcgtggttggagcgtccggagatgacgactttgaatccgaggctcgtgagcagggtgaaccagaacgggtagttctcgtacatgttgagtacgcggggtatgccgatttcgccgcgcgtggcttttttgtcggtcagacggcggtaggcgaaggcacgcttgtatttgaaatcgtacaggttgggccggtcgctgcgtttgcgtttggcgtcgccgccgcgttcgcaccggttgccggtcacatagcgcgatccgtcgtggaatgtggtgatggtgagcttgcagtggttctggcacagtttgcacacgtcgcgttcggtcgtcatcgacagctcgtcgagggcggtgccgtgcaggatgctcgagacggtgtggtccacgccgtcgatgcacgccacgtgcacgccggcggcgtcggtgtcgccgtccgtgtcgtcggcgatgtcgtcgtagtgcatgcgcgcggtgagcgcggcgccgtaggcgcccatgagtccggcgatgttggggcgcgtcacctcgcgttcggtgagcagttcgaacgcgcgcagcacagcgtcgttgaggaacgtgccgccctgcaccacgaccgtgctgccgagctcgcccgaatcgcgcagtttgatgaccttgtacagtgcgttgcgcacgacggaatagcacaggccggcggcgatgtcttcgatactcgcgccttccttctgggcctgcttgacgctcgagttcatgaacacggtgcaccgcgaccccaggtccacgggatgttcggaggcgagcgccgcctgagtgaactcctcgatcgtcaatcccatcgaccgcgcgaaggtctgcaggaacgacccacagccggacgagcaggcctcgttgacggcgatcgagtcaatcacgccgtcggtgaccgccagatacttcatgtcctggccgccgatgtcgatgacggcggtgacgcccgggctcaccatttcggcaccacggtagtgggccatcgtctcaaccacaccctcgtcgagatggagaccggtcgtgatcagaccctcgccgtagccggtagcgcaggaacgtgcgatccaggcatcgctcggcaattcggactggatgcgtttgacgatctcgatcgccgcagtcaacgggctgccatcgttcgtcgcatacgacgaccacacgatctcgcggtcatcgttgaccaaggtcgccttgatcgtcgtggaaccggcgtcgatgcccaggaagtgcgggccacgggctccctcgagcgtgcccacatgcacatgctcacggtgatgacgcgcattgaacgcgtcacggtcggccgcggtgtcgaacagcggcggcatcgtggccgtgttcgacggcaggttcttcagatcctccaatgcattgataatgtcgtcgagcgaccgtgccgggtactcgtcggcatgttcgatctggccgggctcgccaacggcgagcgccgcaccgtaggcgacatacaggtgcgcgtcggtcggggtgatgaactcgtccaccttgccatcgagtgcacggcggaacgcctcccgcagctcgctcatgaagaacagcgggcctcccaggaacacaacggtgccgtgaatgggacggcccgaagccaggccggcaatcgtctgcgtggccacggcggtgaagatcgacgcggcaagatcgggcttggcagcaccgtcgttgatgagcggctgcaggtccgtctttgcgaacacaccacagcgcgatgcgattgggtacagcgtctggtaatacttcgccatctcgttgagaccggcggcatcggtgtcgagcagcgtcgacatctggtcgatgaacgcgccggtgccacccgcacacgagccgttcatgcgctgttcgggggtcggcttcaggtacgtgatcttcgcgtcctcgccaccgagttcgatgatcacatccgcctgcgggatcgcctcgtcgattgcgcgcgtctccgcgatcacctcctgcacgaacggcacatgcacggcatcggcgagcgccaaaccgcccgaaccggtgatggccaggcgcacgggctcatctgcgcgacccagttcggcgagatgggcacggatgtcacgcaacaatccctccatcgtcgcgcgcacgttcgcatgatgacgacggtaatctgcgaacagggtggcatcgagggagtcggaatcgtctagcacgaccgccttgaccgtggtcgagccgatgtccagacctatgcgcagcgggcgtggttcggtgttgagggtctgagagatcgacgaaggttcttgcaccagagaagccatcattacctcgtgtttcgtgcggtattcaagtttggttggcatgccggaagcgggagctctgttttctcgcgtgctggcagccataatctcactattctaccgaatcgtccctaccgatggtcacgacattcggcatggtttgtcggttttccacaccgtgtgcgcaggtgtggaaatctgcgtggaaataagcagtgagaatagtcaggagcgggctgcgggaggataggctaagatggagagatgataggcagtcgcagggtctgggagtgtgcgatgagcaaggaacgagtggtggcgttcaccgatgcggtgctggccatcatcatgacgattctcgtgttggatttggataaaccggatccgctgacgtggtcgggattcgggaagttgtggccgcagtttctggcctacgcgttctcgttcttctggctgggatcgatgtgggtgcacctgcacatcgaatggagcggcgttaagctcgtcgaccagccggtgttgtggacgagcatcacactattgttcttctgctcgctcatcccgtattcgacgagcttggtggctggcaatgtgttgtcctgggacctcgcaatcaagatcgtgggcataatgatcacactgaccatttggccgccggccatgctggtgttcacactggccgccgccatgttcctattcctcaaaagcgcctcggccgagcgccgcatgcaggtgaaaatcaagaaggacgcgctggcgaacaacggcatggccacgccagacgacgtcgccgccgtagggggttcagcggaagagtatttggccgccatagaagctgcgaagcaagccgcaaaggaagccgacgaaggagacaagcaatgaacaccgcattgatcacggcctccatcttcgctatgctggcgggcctgctgcatgtctacatcttcgtgatggaatcgttcctgtggacgtcacgcagcacccgagagaccttctcgatgggtgccgacgaagctgaacagaccaaggaaatggctttcaaccaaggcttctacaacctgtttctggccatcatgtccattggcggcgccatcgtcctatggtgcggcgtgaccgtggtaggcgtgacactcatgaccgccggctccgcctcgatgttctgcgccgcgctcgtgctgctgtgcaccgcgccagacaagcattcggctgccatcaagcaaatcttcttccccgccctcacgctcatcgccttgctcgtggccctcatcctgttcgcgtgagtctcccacactcgttgcggcgtaggaatctgcacatctgattataggtaagatgattgcagattcttcgactgaaacgaggtgcacgatgagcgattccaacgtcgagcgaccgacgcagcggattgacatgcccaccacgcagattccaatgcagcaggggtatgcgccgccgagttatcaggcgccctcctatcagcaggcgaattatcaaccagagagcggggatggaggcaagcgtaggaggaggtggcctgtagtcgtggcaatcatcaccgtggtggcgatcgtgggcggcgtggtcggcggcatcatctacaagaacaagcatgacgaggcgtatgcgcgctgccagacggcggtcagcgagttcagcgaggcacgcaaggcgctgcttgacacgacgagcgattcgccggcgttgcagaagctggtgcgtaatgcgctcggcgtcgacaagattctcgacgcggcagccgatgcggcgagcgcggcggagggcaccgtggcacagcaggggtgtgcggcgaacgcgacgatcatacagctcaatctcgtggcgaacacgctgaacagtgcaaccgaatcattgcgcaaatcgaccgcgcagatcgtgcgcggtgcctctgcagacacagataacactggcgacgagtcggaatctgcggcgtcttccgataccgaggacgtcgcgcaggccaagaggaatctgcaggaggccatagaccaggggcgcgcgctgctcgacacgctcaagcagcggtatgcggattccgcggtcggtaggcagctcaccgcaggattcgaagcggcgctcgacctcgcccaggagaaattcgacgagtcgggcatcaaggattctcgctattacaaggcggcgcaggccacgctcgacgaggcgacgaacgcggtgaacgcgtggattgaccggcaggcgcagaaagcggactagctggcgtcgccttcgccggcggcacgctccttgccgtagatttcgggaatgaaacgctcctggtcgtgcagtttcgcccacaccaccggcttgccctgcctgaacgactcctgcacgtcgagaatgcgctggttgcgcgaaccgcggaactgcagcagtgaatcgtgcaacgtcttgatatagcggccgtcaacgagaatgtcgatttcatgaagcaggtcgagcttgtcttgcgtctcgccgtcgcgcatgagctcctcccatgtgtagccggtccagcaccagatgtctttcgtatggccgaaacgctcgcggatcttgcgcgcgagcggcagcagcacgccggtgttgagcagtggttcgccgccgaggaacgtgatgccctgcacgaagctctgcgccaggtcgtccatgatctgcgcctcgagcttgtcgttgtattcgtgaccggcctggaaatcccagattgacgagttgtagcactccacgcagtggaacgggcagccggagacgtacagcgagcagcggatgccttcgccgtcggtcatgaggaagcgcttgtagtcggcgatcatgttgtgactcatgcgattcgtccactgaccaggcttcggattgttcgacatcggcgtcgggatcgccggcccgcgccccgtctcaccggccgcaaagtcgtgcagtctcggcttccccgtgcttcgccacgtgccgttcgcggaatcattcatatttgcagcctctgccatgccagctccttccctgccatccaagcatatgtggtggatacgcctcggtacacgtggtagatgcgtcccgtatatgtgccgttgatgcgatatgtgccccatcgactcgcgttcgttcgcttgcgtaccctgcatctcccctgcgtaacacctccccttacgtaaaaagggacagatttgggcacttggatgtcccaaattacgcaaatgaaaacgcctgcgtaagaagggacagataggcgccttcggctgtcccaaattacgcaaacaaaggaccatacaaacgtaggacacaacgagaaggcggacccgcaggcccgccttctcatgatcggtgatgcttacttggtctcctcgaaccattcgcgcgtctcgccgtcggcgagcgtgacatgcccggtctcgccggccatgtgcttgacgcggtgggcgatctcctcgtgacggccatgcaccatcgggcgctgcacagggttgcccaggtatccgcaagtgcgcttggtcacattgcacttgtcggggtcggaattgccgcattcggggcacttgaagccctcctccgtcggcgcgaagtcaccttcgaaaccgcagacgaagcaatggtcgatcggcgtgttcgtgccgaggtaaccgatgccgatgttgtaggcgtaatcccacacggcctcgagcgccttcgggttggcctgcaggcacgggaactcgcagtagttgatgaagccgccggaggcgtagtacgggaagtccttctcgtagtcgagcttctccattggcgtcggctgcagccataccgggtaatggaacgagttcgtgtagaagtcgtggtcggtgacgccctcgaccttgccgaacttcttgcgatccatgcggttgaagcggtcggtgagtgactcggccggcgtcgaatacaccgaataatggtagccttcggccttgctccactgcttgcacagctcgttcatgcggcgcacgatggagagggcgaagtccttgccctccggatcccatgcgtggtcacgcatccaatccttgccaaagaacacggccgtggcctcatacaggccgatgtagccgagtgagacggtggcacgctcgttgcggaacagctggtcgacgttctcgttggtctccaggcggccgaaagcaccgtagcggaacagcgtcggggcgttcaccggcgtggcctgcttgcaacgcatgatgcggaactgcagggcctggtgcgccacctccatgcgctcgtcgaagatcttccagaaacgctcgacgtcgccatgggattcgagtgcgatgcgcggcacgttcacggtcacgacgccgaggttcatgcggccgtcctcaacgtccttgccggtcttcgggtcgatccaaccctgcaggaacgaacggcagcccatcggcgccttgaacgatccggtgatcttcacgatgttgtcgtagaacacgacgtcggggtacatgcgcttcgtggcgcattcgagggccagctgcttcaggtcgtagttcgggtcaccctcgtcggcgttcacaccgtgcttgacggtgaacacgagcttcgggaagatcgcggtgtggcgctccttgcccagtccacggatgcggttgagcagaatggcgcgctggatctcacgggcgaaccagctcatgccgagaccgaaaccgacggtgacgaacggggtctggccgttcgagacacggttcgagttgatctggtattccatggtctgcatggcgtcatagatcgccttgcgcgtcatgatcttcgcatagatctcacgaatctgctcgagttccggggcgttcgtgtcgaaggcctcgtcggccggcagcggctcgcggttctcgaaatgcagccagcgcggctcctgcgccttgagtccggccaccatgtcgcgggcgacctcgatcggcgtggaatccgggatcatcgcgtgcgccatgtcgaggttcttcacatagtcgcgcttggcgtactcctcgagcatctcgtcggcgcggttgacggtctggccgccgtactgggcaccggcgatgtctttgatgatctgcgtgatctgcgtcgaggcggtgccgatcgacttcggcgagtccatcatcgcgttgccgagggcgaagccgtgcttgagcatatcgccgaaatcgggcagcgaacagttgttcatcgatgtgaacggcgagtaatccgcatcatggaagtgaatatcgcccttcatatgcgcgttggcgacggcgtcaggcagcatcgagaaggccgaggctttcgagacggcgccggcgagcagatcgcgctgcgtggcatagacgttggagtccttgtttgcgttctcgcgcaccagcgattcgtcgcggttgaccaaacggctcaccgcttcgttgatatcggtggccttggcacgttggatgtctttgttcaggcggtagttcgtgtaggtgcgcgccacctcgtacagatggtcctcgatgagcgcgtgctccaccaggttctggatgtcttcgatcttcgcagggccgttgtagcgttcgcggatctcgccttcgatctggttcgcgatgtcgaggatcatgcgctcctcctgcggaccgacctccttgtcgagatcggcgaacgcagacttcacggcaaccacgatattgaccggatcgaagtcgaccacgcggccatcgcgcttctcaaccagcaccctgtcagtgaacatgccctcgaacacatcgtcgccatcaccaacaacggtccggctcagtgtgtcacccagaatctgagtctccatcgatacctccagaacgctttcgctcatgtattgtgattcaggttgcaatcacgcagacgtgactgccatctcattcgcctctacgagcttacacaaatagccgacactagatgtagtacgaaacgccgcgcaaaagaccaacatgttgtgctttccttggaaatccgaccaaaaatcgatgtgtgagaaaactcacgttttttcggattacgccactcgcgtgagatgcctggatggcgtgaaccgttcgaaactgcggcgtgtttcggcgtgtttcagtcgtcctgagattgcgattcgcgacacgctgcgggagcgggctttactaaattcgcgaacgggaggaatctagactcatggttttcaacaacggataccaaaccgggtatcgacagggctatgcacccgcgccagcggccgggccgaatgagctgccgcgcatggcggcgcagacgaccgcggagaatccatggccggtgagcatggtgagccagaagttccacagcgcggttgaacgatggcccgccgtgtggatggagggccagatcatcgaaatcaacacacgacgctcaggatcggcctatctcacgttgcgcgacaacgaccaggacgtctcgatgagcgtgctcggcttcggtgccttcgcccagatggcgcgcgactacaagcagggcgatcgcgtagtggtgcacggcaaggccgatctgtacgtgaagagcacacggttgagcctgcgcgccgacatgatcaagcgcgtgggtgccggcaatctgcaggagcagatcaaccaactgcgcatgcgactcaagggcgagggcctatttgatgagagccgcaaggtggcattgccggagtttccgaagaacatcgggctgatctgcgccccgcaggcacgcgcggaaggcgacgtggtgatgaacgtgaacctgcgctggcccggcgtgcggttcacgattgtgcacgctcatgtgcagggcgagcaatgcccgccggacatcgtctcggcgatccagcaactcgacgccgacccgaatgtggacgtgatcatcgtcgcgcgcggcggcggcagcttcgaggacctcatggggttctccgacgaacgcgtggtgcgcgccacggcggcctgcgcgacgccgatcatctcggcgatcggccatgaggacgactggacgctcatcgatctggcggccgatgtacgcgcctccacaccgaccgatgccgccaagcgcgtcgtgccggacgtgcgcgagcagcagcagctcatcaccgagggcatcaatcgcatgcgcacgttcatcgcgaatcgcgcgggcaacgaggagcgcctcgtcgaaggctatgcgaaccggccgtcgctgacccagccgctcaccatgctcattccccacgaacgcgacatagcggacgcggtgagcgccatgcgcaacggtttgcgccgtattgtggacgaggagcagatgcaggtggagagactcgccgcgaccctgcgcgcgctgagcccgcaatccacgctcgaccgcggctatgcggtgctgcagaacgccgatggcgcgatcatcgacgacgcctcgcaggtgcaggtgggcgacgagctcacactcaccctgcgtcgcggcaaggtcgtctcgcaagcacaggccgtctacgatgagtgaaagacgaacaccaaggaaacgaataccgaacgggaggaatgacatggcggaagacatggagatcaccgaagtgagcgaaaccgaaccgcagaccgcatcgagcctgagtcaggaggagcgtgagcgcatcgcacagctgccgtacgagcaggcacgcgatgagctcatccaagcggtgcgtgcacttgagaacggaggcctgagccttgaggactccatgaagcaatgggagctcggtgaagcactcgcacagcgcgcacagtcgttgctgagcaccattcgcgccaagctcgacgccgcccaacaggcgcaggcgcagacggcgaacacggcggggacccagtcgaatctggaatcctgatcagtgacgcaggccggagacgtccaccgtggcgagcagcgcgcggtggtccgaaccggggatcgtcagcgagttgacctgcccgatggtcacgtccttgctcgtcacgatgtggtcgattccggcgaacgcgggcaggtacttcctgtctgccggccaggtgaacaccagtccgtggccactcacctcggcggcatcctggaaacgggtgccgagcatgtcgcggaacacggcgtggtcccaagtggagttgaaatctcccatcagaatatagtcggtgtcagggtgttcgttgagctgcttgagctcggcgatcgacctgctccatttctcgaatctgccctccgtgggcgactgcgtgtgcacggagacgaaccgcaccggaatcgccccgttgtcgaagcccactgtgccgccgggcatataggaggcgatggaatcgacgtcggtctggctcggattctcgaacggcagcgcggagaacagcgcgttgccgaaatagccatcggcgctcgaggtctgcgaatacggcagcagctgcgagatgccggcctcctcaaggcgcttgaggaagtccggcgtggtctcctgcaacgccaacacctccacatggttgtcgcgcacggcgttcacgattgcggcggcatcggcatgccccttgtacacattgcaggtcatcaggcgcgccacggcgtcggcagtgtcggcacgcggcagcgactgtgaagacagcgcgcttcccgaaagcggggtgccgttatggtagaacggcagctgccagcacacctggatcgccaggcatacgccggccacaatcgcggtgacccagcgcgtggagatcaacgccaacaccaatgacaccaccgacacaatggcgaaccatggcgtggcggcgagcacgacagacacgtatggcaacgtctgcaaatcaaccggcagcaaccgcaacgcacagctgcagagcgacgccaacgccaataagccggcaatagcccccaacaccctgtgtttgcgcatcatcgccatatatatgctccattcccttgtcgccggctcgaccgccctcccggccattttccgcttctgcgtgccaagcctagccgatgcgtgtcacgagcggcatatccgatgagatgatttcgcttgaaatcggttcgccgtgttgaataccgtgcgtcgtgttgtataatggtcattcgttgccctggtagctcagtggatagagcaccgctctcctaaagcgggtgtcgcgcgttcgaatcgcgtctggggcactttgtttttccgacgtcgcatgccgtaaattcgagatacacgcgtgccgcgcgcccgccatgcagtagagtcgctagaaaacacgccgacgaaagaggctggcatggcgattgaggcacattgcggcacgctgagcgcactgacgctcgcactcccccgttcctgcgcggttcccgagtccaggggaacgctgccgaaaggcatgttcgtggcgaaagtggccgtctcggcgaaaacgaagcagcatctcatccacgccatcgacggcatcacgatgctcgccattctgcgcgccgcaaacacaggcgtggaacaggggcgccggattcccgaagtactggtaatcggcctgcggctcgccgacggcatcgaggaggcgccgcatgacatcgtcgagctcattcaggcacagcgcaaatcgggcatcgtgttcgtctgcgtgcgcaacgtggaattcgaaggcgccatgcgcgaggaagcatgtttcgtcgtgcgtcgcccattgagcgaacgcagtgggcatgcacccacattccatgaattcgcgagcgcatggattccctccggagaagccctgctggagattgcggatgccgctgccaccaccgacgacctgtgggattcgctgtgttcgcaggtgatcttcggcagcacggatttcgccgatctcgacgcgcgtatcgtacgcgcgagcagaatcgcccaattgcgcacgcagatcgccaaactggagggcgaccatgccagggcgaagacgcaggagcggcgcaacgaggcgcatgccaagctgcgcaaggcccgcgcccagctcgagtccctcgaacagttgtagccgagtcgtgcccattcaacggcgcaacgaggccacgaaatcgcccagacgctcgaatccgacctccagatcgctcatcgatgcggcataggagagccgtacatgcgtgctgccggtggcaggtccgaaatcaccgcccggcgtcaacgccacatgggcctcatgcaacgcgcgttcgcagaaggtctgcgcatcgaggccggtggagctgatgttgaaatacgcgtagaacgctccgttcggcaccacttccaacggcagtccgatgcgggcgagagcgtccaccacgaatgcccggcgttccagcagttcctgccggcgctcctcgcatatgcgcagcgactgcggtgtgaagcaggccaatgcggcgtactgcgacggcgtatgggcgccgaggaagaagttcgtggccagattgtccaccgcatccaaagcgaactcgggaaccaccatccaccccaaacgccagccggtcatgccgaagaatttcgagaaactgccgcacaccatggcttcagggtcgacggcgagcgccgactccacacggctgccgtctgcctccacgtcggtcaggtccaaataggtctcgtccataatgcgccatgcaccatggtgtgccgcgtacgcgcatacgtcacgcaatacgtcgggcgcgatcgtggtaccggtggggttggagggcgacgtgatcatcaccgcgcgtgtgcgctcgctccagtattgccggacgagcggctgatcgaggtggaagcgcgtcgccgcggacgtgggcacgtcgaccaccttgccgccgaaggaccgcaccagctcgcggttcgacgggtacgacgggtctgcgatgatcacctcgtcgccctcgtcgacgctcaatgcggtcgccagcagcagtgccgccgaacctccttcggtgatcacgatgcgtttcggatcgacttcgacgtcatgcgccgtccggtagaaccgcgcgatcgcctcacggagttccgacaatcccatggaatccgagtacggcagtggacggccgtcatacaggtcgcgcatcgcctcacgcactggttccggcgcaccgtaatcgggttgccccagactgaggttgatcacatcgacaccttgcgcgcgcagacgcttcgcctcattgctgattcgcatgcccatgaacggcctggccaatgccgcgcgtttcgcaaacggcggccgcatgttctgccgttgcgaatccttcgtctgttcgtctgcacctgtcatatgacactccttcgccctgagctgctcactgttgcccagtatctgccgtttcgccgccgttttcaaccgctccctctacgggcgcatccagaatctgcgatgccagcgattgcaggcgcgcgtcacgcgactgccgttccagctcgcattcccatacgtcgatcacccgccagcccatggcccgcagctgctcgtgctgggctccgtcgcgctcgcggttgcgcgtgagcttggccgtccagaatcccacgttcgaccccggcatcttgaatttcgggcaaccttcatgcatatgccagaagcagccgttcacgaagacgattgtgtggtatttcggcagcacgatgtcgggatggcccgggtaacgcctgtcgttcttgcggaatcggaatccccgtgcgaacagatagctgcgcacgagccgctctattgacgtgtccttgccgcgaatgcgcgacatcgtgtagctgcgcgtgcctcgcgcgtatttggaatcgccagaatctgcagatgtgcccacgcaaccattatcaccggtcccgcggatcgccgaacgcacacgattccttcacatagtgagcagacttcgccgttcgcataccgtttcgcggacgattcatgcaaccgtgacagtatggaacaacaatatggtggagggaaacataaggaggcaccgtgggattacgtaatcgacacacccagccggtgtattacaacgaactgtacgatattgaggatttcattggcacgagctgcctgaacaacgacgatctgcatgcgcccacgttcctttgggattcctcaatctgcgaggagtcgcgtgacgacgacgccgagcgtctgggcacgccggtggcgcccacggacgaagcggagacggtgatgacgctgtcgatgcaatggtatttcgactcgctcgccgccattgtgccgggtgcgcaacgcacgggtgacggcatcgagatgccgcttcgcgatatgcccaccttccgcattgattcgcaggcactgcagggggtgagctgcgtggtgggcaacgcggtggcgagcaaccattggctcgacgctgtgaacaatctggcacgcgcgctcgaaatcaccgccgagttcctcaacaactgcgccgaccgcgacaacgagggcctggacttcctcgaagacacgatcatgcaggtgcaggtgtacatggattccgtggcccgcaatgcgagcccggacgtcgcggccaccgcgctgcgccgcatcaccgacgtcgcctgcagcaaatactttcatttgaacgccacgaagatgatcgagctgctctcgtgcacgctctccttcgccagctacgacgacacacgcgtgctcgcctacgagtcgctggaacgcgcagtggactacatgcgcgcgaatctcgacgagatggataatttcgacaccccgtccggctcctcgcatgccagaaacgccgacgacggggcatcgcccaacagaagcgacccgcatgcacaggccgctcccaccgacgacattgcccaagtgaacgagcagttcgagcagatgatggccgccgagttcgatgccgacgacgacctcggcatcgtagtgccgcacgccgattcggacgatgagatggcgctgaatctgacattggatccagaggccttcaaccgccgtctgcatatctacgcacgtgagcagttcgaacaggcagtgcagttcctgcgccacgacctgctgcgcatcagcggcgacgatgcggcggccgacgagttgctgcgcgaccacaccgacatggaaccgctggccgatatgctggcgcttcggctcatcagcacgaagcgcttccatgaactgttgagtctggcgatccgcatcgaacgcgaacggccgaaccagcagatcatgctgttcccggagacgctggtgccataccagtgggattcgatccgagagatcgcgctgcagggcatcgacaaccgcgacgagctcaagcgcatctaccgcgaacgcatcgtcgaggcctacgacccgagcgatacgcgcgcattggcgaatctcaacgccctatgcagcgaggagggcgactgggacgagcaggtgcgccagatcgtcgaggaatatgcgaacggcgaagggcgctacgcgcgcaacgtgatctacgagcagatgctcatcgccgaagacatggtcgaggaggccgtcgaatacgtcgagcatttccccgaggccaaggaggatctcgcgctgctgctgtggtgacgcatcggcatgggtgccgcagggcgtctgggctcagcggcgccgtccggtgtgcttgcctcccacgcctccacggcctgccggaccccatgggccttcgccagctaccttgagcgtgcccaggtggtggcgcatcgccacgagcatgatatgggcgtcttccagccccaaatgccgttcatggctgttgccgtcaagcgctccttgacgtttcgcatatgcttccagggtgttgtcgccgtgcgggtggccgggcgagggaacggagccggcatcccaatggcggctcatcggcatcgtgtcgagaatggtgatctcgccgttgcggtatgcctcggcgtagccttccacgttcgccatgaagaaccggtgttcgaaggtggcgttgtgcgccacatacggttgttgcatgagccgttccagcaacgcctgctgcatgcgcggccattcgtcgaagatgggctcgcccgcgattttcgtcacgtcaatgcccgtcagctgcgcgatgaacgggttcgccacctcggcacagcgcagcggcacgccgaacgacaggcgcgactgatcgtatgcaccatccgcggcatagtcggtctcgctgtagacgtcacgtgctttcgccccctccggcgccggcgtttgcagattcatgcgctcgaagcctacgtcgatgatgtagtcgcgccatgcgcttgtgcccgtggtctctatgtctatgccgagcaccgcgtccacatcgcgtcccggcagatatgccatgcgccagtcatactggctgtccgaacgtcttggagccgccggacggctcgtctgccccgattcctcggacagcaccttgtcgtcggtgaatgacgacagactcgcctgctgcatcatctgcgaccccgccttgcgctggttcatcgcatggttgcgccgttgcgcgcgctcctgcgcaagttgggcggaacggtccacgatctcgttcgcatgggcgtcctcattgccgtgcagcacaacgaaggcggtgccccgctcgaatctgcgctccacattccacaatctgcgcaccttgccctgctccatgatcagcgtgatctcgtcgttgagcctgcgattggcgtacgcaagcgcgcgggcgagccggaacgaatcgagattgcggtcgaagtcgcccatgaacacgctcgtcacgttctcgagaatcgcctcgagccgctcgcgaatcgcatagtcctgcatgagcagggcatgcgcgtcgtactcgtcatgcaccaggtcgagtcgggctccggcacccacgcccgcaacgaagtcgagcgagcacacccaatcccaatcgatgatgcgttcgtcggcgtcgcgctccatcacggccgcccattgcgtcacgtcgtgtttgctcgcctcgagccactgcgtattctgttcgtaggtcatgtgttcatcgtaggccaatcatgcccgattgtgtagcacggggaggcgttgtggatatctcggcgcattcgtgcacctgtggatgacgaaacggggccgcccaccgcatgtggacagccccgtggataacctcttcctcacagctcgaagccaagctccttggccgcctgcgtgggcaccggatcctgcgcccagaagtcctcgagattctcgaccgtggtgagcgagcggatctccgcctggtctatgtacagctcgccgctcaaatggtcggtctcatgctggaagatgcgcgccggccagccatgcaggtgttcctcatgttccttgccgtcctcatcatgccaatgcgcgatgatgtcgaggtagcgtttgcgcaccgcctggtagccgtcgaagctcaggcacccttcgtagaaggagcgcgtctcctcacctgccgggcgatagacgggattgataatcgcgtggaacgggaactccgctatctcgcgcggatcgccgtcatcatcaccgttcgcgtggtcctccaccactgcaatggcaagattgaggccgatctgcggaccggccagacccactccaggcgcgtcgagcatggtcttgtgcatcgtctcgatgagcttgtgcagcgtatgcttgctcagctggccgtcgtagcgcacgcactgctcacgcagcacgggctcgcccgcttcgactatgggcagcacgccttccttcgcggacttgagcagacgttcgacatccgcattgagctcgatgtcgacatggttcttctttccgaacatgttcagacctttctggaattcgctgattgacgtgcgctcacaatgcgagctcgtcggcgacgatctgcgccagacgcgcagtgacctcgtcggcctgttcctgcgtggcggcctcggccatcacacgcacgagcggttcggtgccggacggccgcagcagcacacggcccgtatcgccgagcagctcctcctcgcgggcgacggcttcgagcacggccttgttcgtcttggccgccatcttgtcgacattcggcacgttgatgagctgctgcggcagctgcgggaagtcggcggcgagctccttgagggacttgcccgacttcaccacctcgttgcacagtgtgagcgcggtgagcgtgccatcacccgtggtcgcgaactcgcggttgatcacatggccggactgttcgccgcccaggctgtagtcgccgcgcagcatctcctcgagcacataccgatcgccgacgttcgtctgcacggtgtcgatgcccatctctttcaatgcgagcttgagccccagattgctcatgacggtcacgacgagcgtgtcgtggttgagcttgccctcgcgcttcttggcacgggcgagaatgcccatgatctggtcgccgttgaccatgttgccttcggcatcggcggccaggcagcggtcggcgtcaccgtcgaaggccacgccgaggtcggcgcccgaggccctcaccatcgcctgcatcgactccgggtgcgtggagccggcgttcttgttgatgttgtagccgtccggcgaggcgttgatcacaatgacgtcggcgcctgcgcgacgcaacgcctccggggccaccaccgaggtggcgccgttagcgcagtcggccaccactttgaggcccttgagcggctgctcgttgccttccggggcgatcgccgagacaaggtggtcaatgtacaggttcgtcgcggtcgtcgtatcgtggctcacacgccccacaccggcgcctgtgggacgctcccagtcctggccgagcacggcctcgatctcgtcttccttcgtgtcgggcagtttgaacccaccgcgcgcgaagaacttgatgccgttgtcgggcatcggattgtgcgaggcggaaatcacggcacccatctccacattgagcacgctggtgaggaaggcgacacccggcgtgggaatgatcccggcgtcgatcacgtcgaatccgccggcgctcatgccggcagccagagcatgcgaaagaaagtcgccggaaacacgtgtgtcacggccgatcagcgcacggtgccggttcgtctcgcgaccaccgtcgtcgccgagcacacggaccgccgcgtcccccaaatccaaggccaactgggcggtgagatcccgattggcaagccctcgaacaccatcggttccaaacatacgcggcatatacatcctctattccatttcgcgcattcctatattccgttccagtctacgtcaccagtgcccctttcaccgcgcatcattcgtcatggatgagctgtacccgtgtgcgcaagtatgcgtttgccgtctgtggcacaccctgatgcgttacatacgtgcgaatatgatcttattcgtctcatctccatgtccctccatatgacgaacacatgcgcttgcacacagagttgtcatatttgcagactccttgcgctacattcccgtatatgcacgcacgtcttcgtcgcattgggggcttccagatatgattaatccgtgcgtcgatgcacgtgtctgtcacgttcgaagtcccaaatgagtcatgagactattctgagactattcactgacttgccgtatccgccgaatatcaacaatacggaggggatgagtcccgcggcccatcccctcccatgcccagcacatcaccgggcggattcaccaatcgacgcgttgaaatcgctcaccatacgggtgcgatgcgatgcctcgacattggccttgaccatgcgcagcagcgcgttgtcggcatcctgatgcgcggcgagccaacggtcgcctgcttcgacgagcttggccgggtcggcgtatgccgggtacaggtcgccaatgagcacttcgctcatatggaaggtcttgttcttccagatccagtcgattgcctcgaagtaggcatccacataaccgtcggcgagatcggcgtcatgggtgccggagaagccgcgagccacctccccgagctggctgttggtcagctcgtcgttgtgcagcgcctggtcgaacgcccagtccttcgattccttgctgtgcagcgaggcgcgcgtgcccacggcgaactcgcggttctccgtggtgtcgcgacgcttgagctcggcgtcgatgtctgcctgcttgatcgcattgattgaagcgagcgcgtgcatgatcgaccaacggaagttgttgtcgagctcgagtccttcgaacacgagcgaaccggagagcaagccacgcacggtgtcggcgaactcgctgtcgccttccacgccataggtgaggtaggcgctcacgagctggaactgctcgtcggagcctgccttggcctgcttggcgagcgcgaacagttcgctggccacatgcttggcgatccgattgcgctgcttggcgtcggtgtaatgccagacggtcgttgaaagcatggcgagcgcataccggaacgtcgtcgactcggtttcggtgccgagcatcttgagcgtcgtgtcgatgaagtcggtggcggccagctcaccgtcgcgcgtcatgtcccacagcgacagccagatcacggcacgggcgagcgcatcgtcgaagcggtacaggttcgccatggcgaaggcgaggctgtcgtcgtcgaaacgaagctttgtgtaggtgaggtcgtcgtcgttggcgagcagcagtgacggctttgcctttccggccgcctgtgccaccgtggtgtgttcgccgtccacatcgagttcgatgcggtcggtgcgcacgatcttgccggtctgcgggtcttcatcgtagaagccgacggccaggcggtgcgggcgcagcaccgggaactcggtcggcgcggcctgcgtgagtgtgagcgacgtgatcttgccgtcggcatcggcctgaacagcggtgctgatcgtgttgatgcccgcctgttcgagccacttggcgctccaggtcttcaggtcgcggcccgaggtggcctcgagttcgtcgagcaggtcgttcaatgttgcattcgagtaggcgtggcggttgaggtaatggctgatgccctcgaagaaccgctcgcggcccacgtatgcgacgagctgcttcagcacggaggcgcccttcgcataggtgatgccgtcgaagttcacgtacgtgtcgttgaggtcgttgattggcgcgacgatcgggtgcgtcgtgctcagctggtcttgtgccagtgcccagctcttctcgcccgagcagaacgtggcccaggcgtccttccaatcggtggcctcggcggtggcgagcgtggaggtgaactcggcgaaggattcgttgagccacaggtcgttccaccacttcatcgtcacatagtcgccgaaccacatgtgggcgagctcgtgcagcacggtgaccacacggcgctcggcgagtgcgtcggtcaccttcgactcgaagacgtacgaatcgcggatcgtgacgaggccgatgttctccattgcgccggcgttgtattccggcacatagatctggtcgtacttcgcatacgggtatggcacgccccaggtcttggcgtagaaggcgaagcccttcttcgtgatgtcgaacaggtagtcgacgtccttggcgaacgcgtctttgagcgcctggcggcagtactggctcattggcacggtgcgtccgtcctcgttctcgtaggtggtgtgccaggcggcgtaggggccggcgcagatggccgtcagatacgagctcatcgtgggggtggtggcgaaatgccacagtttcgtgctctcggccggcttgcctgccagcgtgccgtcggcggtgaggtcggccaggtcctcggtggattccaccggcatgtttgacagcacggtccacgactgtggggccttcacgctgaacttgaacgtggccttcaggtcgggctggtcgaatacggcgtagacgcggcgcgcatccggcacctcgaactgcgaatacaggtacacattgccgtcggacgggtcgacgctgcggtgcaggccctcgccggtggtggagtaacggcagaccgccttcaccacgacctcgttgtgctccttgaggttgttcaggtcgatgcggtcgtcgtcgaacacctcgttcacgtcgagtgtctcgccgttcaccgtcaccgattccacggagtcggcgatgaggtcgaggaacgtgctttccccggcatgggcgccgaagcggatcgtggaggtggagacgaaggtcttcgggccctgcgtcaagtccagatccaccgtgtattcgattggataggtgatgatcgccttgcgctcctgcgcttccactcgggtgagattcgatcccggcatggattctcctttactgctctgtgtttcctatgcttagtactactctatatgaatctggtcggattccgctcgccgcacatggcaaacggcgcccggtccgccggacgtgagacttcggtccacgccttgggcgaatcgggcgtcgcgtacggccgctcagtcgttgtacgactccatcttgttcatgtcggcggcgacatccgccacgaccggcacgatcatcggcttgcgcttgagctcgcgcgaaacccagccgccgagcgtgcggcgcatgatctgctggagcttgtgcgtgtctttcgtgcccgtcatcatcgcgtcgcgcagctgctcgacgatctggtgacgcaccttctcgaactcgctttcgtcttcagcaacggcgttgaggtacaccttcggtccggagaccacctcggccgcgtccgtgtcgacgacggcgaagcatgacacgaagccctcggtgccgagaatgcggcgcttctcgagctcctcgtcggtgagctcgcccaccgaatcgccgtccacatagatgtaaccgcagggcacggagccgacgatggcggccttgccgtggtagaggtcgacgacgtcgccgtcctcggcgagcacgacgttctcgggctcgatgccggtcttcacggcgatcaggccgttggccacgagatggcggttctcgccgtggatcggcatcgcgttcctcggcttgacaatgttgtacatgtacaacagctcgccctcgttgcagtggccggagacgtgcaccgccgcgttgtcgcggttgaccacgcgcgcgccgagctgtacgagcttgttgatcaccttgtacacgccgtgttcattgcccgggatgagcgagctggcgagaatcaccgtgtcgaactcgttgatcgtgatgtcgcggtggttgccgtcggcgatgcggccgagcgcggccatcggctcaccctgcgaacccgtgcacatgtacacgagcttgttgtcggggtagtccttggctttcttgacgtcgatcaccgtgtcctcaggcaggtgcaggtagcccagatcggcggcgatggccatgttgcgcaccatcgaacggccgacgaacacgactttgcggccatacttgtgggcggcgtccaccacctgctgcacgcggtgcacgtggctcgagaagctggcgacgatgatcttgcgcgtcgcggtggcgaacacctggtcgagtgccgggccgatcgaggtctccggcttcacgaacccgggaacctcggcgttcgtcgaatccatcatcagcaggtcgatgccctgttcgccgagcttgccgaactccacgagatcggtgacgcggtggtcgagcggcagctggtcgagtttgatgtcaccggtgtcgatgagcgagccggccggcgtgcgcacgcacacggcgagcgcgtccggaatcgaatgcgtcaccgagacgaattcgaggttgaacggacccaccttgagcttgtcacggccttcgacctgcgtcatcaccggctcgatgcggtgttccctgcacttcgcctccacgaatccgagcgtgagcttcgaaccgatgagcggaatgtccggacgcatcttgagcagatacggcacgccgccgatgtggtcttcatggccgtgcgtgagcaccagcgcatccaccttatcgagacggtccttgatgtagttgaagtcaggcagaatgaggtcgacgcccggctgctcctcttccgggaacagcacaccgcagtcgatgagcaaaatgtggccgttgtattcgatcacattcatgttgcggccgatctcacccagaccgccgagcggcacgatgcgcatcgagcccttgcggtacttcggcggtgcgacgcggttctcgtcctgcgtgtcgctcgtggcgagcggcttgttcacgttgatctgcttcctcacccgtgtggacgtattgcgggtggacttgcgcgtgcgcgggctcttcgcctggctggccgccgacttagtgctgcggcgcttcgtgccggttgcggattttcctgcggagcgtttcctcgttgtctttgcttcttgtgttgccatgctactttctcttcgcatttccttgattattgccgttgcctttgcaatcggcgaggtataaaaaccaacggctgccgcttgggcaaccgttgtgtgcggatcattccggaatgagaccggatgcccgcaggccgtcgcgtacgacttcgatctgttcgtcgttcggcccgatgttcggcagacgcattgttgtgcattccatgatgccgcgcaccttgagcgccgcctttgccatgaccgcctggaacccggtgccgttcatcgcctcgatgaccggcgcgatgcggttcgccaggccctgtgccttggcgatgtcgccgcggtcgaacgcttcggcgagctcgcgcatcggtttggcagcggcatgggccaccaccgagatgatgcccaccgcaccgatcgataggaacggcagatacagtgcgtcgtcccccgaataccaagtgagaccggtctccatgcgcttgcgtaccgctccggcgatgtctccggtggcgtccttgacggccttgacgtggtcgagttccgcgagatgcacgtaggtgtccagtgcgattctcacaccggtgcgcccaggcacgtcgtagacgatgatcggcttgtcggccgactcgttcaccgcctggtaatggcagaagattccctgctgcgacggccgtgaatagtacgggcagacgacgagcacggcatccgcgcccgcctcctgcgtctgttcgaccatgcgcacggtatgcgcggtgtcgttcgaaccggcgccggagatgaccggcacgtcgacgacttccttgacggccttgacgagttcgaccttctcatccatgtgcgtcgtcggcgactcaccggtggtgccgttgaccacgaggccgtcggcaccgtcggccaccagctgtttggcaaccgtctgggccatgtcgaaatcgacatcgccgttgggcttcatcggtgtgatcatcgcgggcaatacgcggccgaacggggccggatcgagaagatgcataataccgtcactcataattgcaacggtacttgctagttcggacgcgtaccgcccgttcgctcacaggtcgaggaattgatcgagcccgacggtgagtcccgggaactcgccggaatcgaccttgcgcacggcgagcagcacgccgggcatgaacgagatgcggtcgaaggaatccgctctaatcaccaactgttcgccggcattgccgagcagcacctcctcgtgggcgttcagtccgcgcagacgcaccgcatgcacgtgcacaccgtcgatcaccgcaccgcgggaaccgtcgtcggtctgcgtgttgtcgggcatctcacccagaccggccgccttgcgggcgtcggcaatcgcgtgggcggtgtggatggcggtgccggacggcgcatcgaccttgtcggggtgatgcagttcgatcacctcggcggattcgaaatagggggcggcgatgcgtgcgaacacgtctgcaagcacggcggagatcgcgaaattcggcgcaatgaacacgctctgcttgcgaccgtcgattgtctcggtctcagcgagtgcggcgcgcacctggtcgagcttctcgtcggtccaaccggtggtgccgacgacgacgttgacgccctgcctcacgagcgtgagcacattgttcagactcaccgcgggcaccgtgaactcgacgaccacatcggtgttctgcggcgtgatctgcgtcagatcatcgccggcatcaagcgcgagcgccaactcggtgtcgtcggcggcacgcaccgcctcgaccacgtgcgaacccatgcgtcccttggctccgaccacggaaactcgaatcatacttcctcccttgggattgtgtgcatctgcacctaagagtaattcgtggcgtgcatcacgcgttcgggtcgacggcctgcgccttgcgggaggcgacataccagccgagcacggcgaaggggatcgcggcgagcgtgtacacccacgtcgtcatcacaccggcatgcgcatcgatgtggtcgagcaccatgccgccgagcagcgaacccatcgcggcgccgatctgcccggccgtggtgagccatgagagtccctcagtcaactggctctccggcaccgtgtctttcacaatgagattgcctgtggcgaacattggcgaaacgaccaagccggcaagcagctcgacgatgccaagcacccagtagatgtccatcgtcacgcgcatcagcatgaagcccacggtgagaatgcacaggcacacgatgagccggcgccaatgcgaaccgcgatgctggcgggagccgaagtagaatgcgccgatgcacgaaccgacggcgatcattgccagctggagccccaggaagcggtcgagatggtcggcctccatctggccggtcatcgacacgtcgaaagtggtgaagctcatgttgaagcagatgaacgcgagcatcaacggcagaatcccggcgtacgacagcacgttgcgcgtggtcctgcgcgactggctcaccatgccacggtgcttgcgctccacaccggcacgctgcccggcgacatgcgagccatctgcctgggcggcgaaaccggaacgtgccatgcgcacatcgtcgtcgtcaccgttcacctgcaccgtctccacggcgtgcaacaccggcggttgcgtggatctgagcgagaagaagatgccgccgccgatcgcgcaggcggcggtcggcacgaacagctgcgaaacggggtgcaccgatgtggcgagcgtggcggcgagaatggggccgaaaatgaacacgatctcgtcgatcgccgcttcgagcgcatacgcggtgttgagcagatccatgttgtcggtgcgttcgagcaagtaggtccatctggtgcgcacgagtgcgccgaacgagaactgggtggcacccatgaccacggcgagcacgaacagcaatgggatcggcacgcgggcaagcgccgcgaaggcgaaggcgagcatgacaatcacctgcacggtgagcgcgacacggcccaccttcacttggccgaagcggtcgaacaggcgcgcgtagaacggggtcacggcggcgacggccagaatgtagacggcgctcatcgcaccggccacggtccagttgtcgtacagatgattgagcgcgagcacgatccccaggctcatcatcgacatcggcaggcgcgcgaaggcggcggagaggcaaaacgccttggcccccttgagcctgaagagccgcgcgtacggcgagcccgagccttgtgccgcctgcgtcgccccatcggccgttttgggaaggttggatggcttcgaactcatacggccggcacctcgccccggtacacgaacatgtcgtcgcgaatgccatcggcacgcccgttgtcttccggatgatccgcgcgcagccgttcggccacgcgttgcaacccgtgatgttcgtaataggtgtagtcgcagctggtgtcggtgtgcaggtagaacgcgtgcacgccgttcgcgcggaagccctgcagcagcgcattccacaacgcgcctcccactccatggcccttgaccgccggattgaccatgaacagcagcaattcggcctgcgtgctctgcccgaccccgctacgcagttcgagttggtggtcggtggcgcggaaatggtcgaatccggagcgcatcatcttggcgatcgggttctcgtcgatgatctgccgcaggtcaccgagcatgccctccgtctgggggaacgccaacggctgcccgtcgatgcgcgccaacgtgacgccggcgaactcgccgtcggccgtcaccgccacgcaggacgccgtggcggaccgcatgtattccagcacgaagtacctcgccagttcgtacgccatgggggtgccggtcaacggtgcagcctgcggccatacctcgtcgaacaccctggccacatcctgcaggtcgccgagggtcatcgcacgcagggtgagatcgcggttcgccgtgctcgacgcactggcaacgttgtcatgtcgattattggtgtcgctcatatcactcctcatatcgagtcagtcatatgcgcccgcccgcatattcgccaacgatgcacgacgcgtggaaggccgtgacgtgcgtttccccgccacctatggccgccgttccacgcacgccgcccgatgcccatgtcgcatgggtcacgccgagtcgtgtgcgttggcatgaaaacactgcctacactaactacgggtgtagattgacgccgtgagcgtacgctaatcgttatcgtcgggttcaggaacgccggcgcgcatctcggcgagcacctccgcctcgctccgttgaggcgcgaccacgagcgctttcgccgggtccttctcgctgacgtagtagagggcggcatcgatctgactcatcgggatgcgtttctgcagcgcccagaaataccggtacatgtcgagctgggcgagcttgccggcgcgctgctgtgcattgcgtggccgcgagccggttttccagtcgatgatcgtataccgcgcatccccactcgcaccggacgtgccgtcgccaagaccgccatggaacacggcgtcgagcttggcatccacgcgcttgcctatgccgctgacgaaagtggagacggtctgctccacggcggccggttcacgtgccgaccatgccgactcgaggaaccgctgtttccatatgagcagatcgcgttgctccctgggcaccggacgacctccccgctcggcctgttcgacggcttccgcctcgtgcgccacctcgcgagccatggcctcctgcgagatgccgtattccgggttcacccccgcttcgagataccgctgtgcccaggcgtggaatctcgtgcccgcctgcgcctgaggtgtgctcacttgcggcacggggcgaatgatctccaaggcgaaatccgtggcgttctcgcctgcctcggcattgcgctgcagaccggtggccgtgagtttgtctttggcggccagcacgcgctgcccgcgcatgcgcacggcctgctcaatctcgtcggccgtcatgccttcacggatcagcgtcgccctgttgtcgatgagctggcgcgcccgctccagcagcgatctgccgtcgccttccgcggtttcgcccggcatgtctgtcggattgttttgcgacatgcgctgcaccacctgtgccgcgcccttccgcagtgtgcggtgcatctcttcgctcagccgacttggccatggcagatgctgttccgtatcgatcggctccatgggttcctcatagggttcgtccacaagaagcgtcgcaaattgctcggcccccttcccgacgatgacgccctccggtctcttggcgccgcgttcatgcagcgagcgcggctgcgtggactccagatcatcgtaggtcacggcggtgttgccggcagtggcggcaaccggccgggccggcgcggtggtctgattgtcgaacgcggtcagttccacacgctgggagaacgagtcgtcgcatgacatggaatcgcgcaattcccgccagaacacggagggggcgcccgactccttggcgttgtcttccggtatgcggctcgtcgtggcgcccacgctgtaggtgaccaatgcatcgtgcttggcgcgggtcaacgccacatacatgaggcgccgctcatcggcatgcagggcacgaccacgctcctctttctgcgacaggttccacgcgtcgggctcgcccagctcgtcgaggagcacaccattgtcgcgcagcaacgcgcgtagttcaccgtaggcgtcgttctccaggctctccaccgaatcgatgtcacgcaatgcgcgtaccgcgctctcctgcaggctcgacgcatcggatccccccgcatcgggaatcgtggggaacttcggcagaatggcggcgtccacgcgaatcggcaccgggaccgcctctggactctccagccagcttttggccgtctcctcgtagagcggcggctcccaatccagtttcgacccgcggtcttccagtgccttcaccctcaatgcgtcacccttattcgaggggaatgcgccctgttgcatgcctacgatggccacggcgtcccattccaatcccttcgattgatgcaccgtcatgagcaccacatcggcgggttcatcgccgaggtcagcggctgcctccggcatatcgctgccattcgccatgtcgaggtaggtcaggaacccacgtaatgtaggacgctgctgttgcgcgatctccgacgtgtaggtgttcaccgtctcgagcagcgcatcgattgccgcacgcactgcatcgcgcggagccggcgctccccccgttcgtagactgcttgccaccatgaggtcgacgtcgaggttcaacgcctccaccgcggtgtggatcacctgcgcaagcggctggtacatctcgtcctgcacgcggtgcatggcccgcacggcctgcatcacgccggcacgcccctcatcgctcagcccggcggcttccagctgcgcttccacatcgtcgcgcaacagcatgtcgatcaggtacaccatgttcggcgcattcctggcgtattgccgcaccaatgcgccccattcgcgcttcggcgtgccggcgggggcgagccccgcctccacgagcgtgcggaagcggtattcggtgttcagatcggcggcgcgtcgggccagacgcttgaggtcgagggcgcccagagcatagcgtggtgtggcaagcaggcgcatcaacgcgttggcatcggtgtggtcgcccaccaccttgagcagggccagcacatcctggacttccggtcggtcgagcatggctgaaagacccacggcacgcacacgcaacggcctgccgtcgcgcaatgtcacctggctcagctgatcctcatacaaggccatcgacttcttgccgcgaaacagcacggccaccggcgaatcaccgggcttgcaggcatcaccgtactgttccacggattgtttcacgaatcgtgtgacggcgtcgacctcctgtccgcgggtctggaagccaagcaccgccaaggtgccctcatccacctcgacgctgccgtcgtccacattgcgcagcggctgcaccggcacttcctgtgcgttggcgctgctggggcgctgttccacgcggcgcagcaccttggtgaggttgttcgccccctgcagcaccacccgcgagttgcgccgtgtgcgcgtcatcggcaacggctccgcggcggccggcatgtgaaaatcgttgatgaacatgcggaatgcaccgggcgaggccccacgccatgcgtagatcgactggaacgggtcgcccacggcgctcacggccgcgctgcggtcggtgccatggggttcgtccacatggaacaatgcggcgagcaacgcggattgggtcgtcgatgtatcctggaactcgtcgagcagcacatgggtgaactgacgccggtagtgggcgccgatcgacgggaaccgttcgaccagctgataggcggcgatcacgaagtcgctgtattcggccatatgccgccggcgtttctcctcgtcgaactcacgcacgagcccgagcagcacatcgcgtttcatcgccaccaggtagaggtcacgcgcggccaactcggcgtcggcatgtatcgcttcaccgactgcgtccttgtcgccgggggtctcgacgtactctccgcccttcttctccgcctttttcctggctttgagcacatccttcaccgcctttggcgtggcacccctttgccgatccgccagcggcccggtgagcaggccggtttcatcggtttgcaggaggtcgaggatctgcgtgcggaacgccgcgtcccattgcgttatccgctcgatggcatcggccacggtgaggcatccattgccaatcatcgaattcgcgatgttgttcgccagtgcgcccacggcatccaccaccgtgccgaacgagcccatgtccactggcagttgcacgatctcgtcgacatgccggcccaccaccgaggcgatgatctggcgtgcaccggcgacgctcagcggctgcgtctgcgggtcgaaccccaccagcaatccgtattggcgcacgatcgactggaagaacgcatcgtaggtacgcacatcgggtttcatgaaggcgagccgtgcagggtggggccctccctccctcgcacgttcacgcgcatcgtcgagcaccgccttcgacactcgcgaaagcagctcggaggcggccttgttcgtgaaagtgagacccagaatatgctccggaggcacgccttcgtgaatcaggtggatcacgcgttcggtcatggtgaacgtcttgcccgagccggcacccgccaccacaatcacgttggcgttggcatcggcatcgacgatccgctgctgttcggcgcttggaaccggcttgtttgactgtgccatattcgctcctgcctattcccattccgtttcgaataccgtggccatcgcctcattgcaggctgcgcatacctgcttgtggcggcacgctcccctatgggcgtccgtcggatgcgccacgatgtggtcggcctgtttggccgcggccgcatagaacacgcgggcaagcatcgtcaacgcccacaacgtgccctcctgcgcaccggcgagcaggtcatgccacacctcttccggaacgccgtccggagccttggaaggcagctgcatcttgaacagggagctcatgtggggcatgtagtaccgtgctgcgaacccggtgtccgtgacggcgcccccctccatcagcgccggctgataatacgattccactcgtgtggcggtgcctgccggcgccggctggtccttgacgaagaacagctcggcacggctcaccttcgggcgtggcccggtgagtgcggtcgtggacccatcggtgttgaaggccagcccaagctggtagcacacaagctgcagatcgctgaactgctcggcgggtgagaagctgttccccgtcttgtagtccacaacccgccaatgttcgtcaccattgtcgaatcgacggcgttccaggcggtctatgcggccattgatctgcacctcttgcccatcggccaattgcacgggccaaccgtccatgagcaccccgagtatcgcccgcatctgctgcacggtgagctttggccgatccccggcatggttgtaggcgtcggtgatgctgcgcaacgtgaaggctccttcgaaggagcattccgcgaacgactcgaccaaggtgcctatggcaccggtggtcttatggatgtactcagcctcgttcgaatcgacgaaatacctcgcgatgttgaacagcatcgccttggactcagcatcgcgctgcaatgccgcgaaccgctctgaggcgtcctctatgcccagcgggtctatgcgccgcggcgcatagtattcgtcgaacatcctgtcggctatggcctgggccgtctgctcacgccatgtgtcggtatgcggcccctgaatcggcacgaattgttcgtagacctgcggcagatcccaatggtgctcggtcgcgtattgcgcggcatcgtgcacgagcgtgccgaaatccgccaccaccgcgcttggggtggggccgctgaaatcgcgttccaggcgagcacacaccgcgcacccccacagtcggtcgacctgcgagggcgacagcacgatcggggcgaacggatccgtcggaacactcatggcttggggcgaggctccggattgtgccgagcccgcgttgagactgagcgccgtcccagtggattgcacgctgttcccggattgggtgcgctcatgacgccccggcgatcgcgccccggtgggggcgtcgcgcaggaacggccaacgccgcgggtcggcctcgtcgactcccgccgacgccaatgccgccaatgcggcgacggcatcctggaattccgcggatgattcctcactatgggccaacgtcatacgggccaaggcgatcacaccccgcatgctcgcagtgagggtctcgtcaccggcatgtcgttccgattccttcacgctatggccatgctcagcagtgtccaccgatgtttcggtctgattccttctggaatccgcattcccggcatcggatgcgtcggccagccgttcggccaatggccgctcggcatcgtcacgggtgaagcattccggcaggtacgcgtacaggaaatcggagggcacggcatcgtcattctggctggcgctcacgttcaatgtgccgttggcgcgggtgagcgccaccagccagcccttctgctcggacgccagcacctcgtcgagctggccgccgacctcgttgcggtgccgggtctggctgccgtgcagggcgatatccaccaaatcctcgccgccgaacatggtgttacgggcggccagattcggccagatgccttgttgcacggcgggaatccacacatgctcccagctcagtccggcagtgccggcaggcgtggtgagcgtgaccgcctcgtcaaccggtgccaagctggccagcgaatccgcctcgatctgcagctggcgcacctggtcgatgaaagcgttgatgtcgggggccacgccttcggattgcacgtagttgaacaaccgcatcgccgtgtcgagccggtcgttggcggcacggccgtccggcgagtcgaaaatggcctgcaccttccacgcatcggccacatggcacgctttccatgccgcctcaagcgcgtattggggcgccttcgacggcaaggagccgaggtcgtcggcaatctgccccacaatgcgccacagcagattgaaattgcgcacgtcttcgttatggtctccgcacagcgcctcgagcacatcgagcagcgtctcgtcatcaccttgcgcaaggagcagatataacgcatcaatgccgaattcaaggccgtcgcccaccttgtcggtgtcgctcagccgcgaatcgtccacgacgatgccactggcctgctcctgtgcggcatgcgcggcgcgcaccgtgctcgcaagggcatcccattgcgaacgcagatccgataaagcggatgccttcaccgattcggcgagcgcgctccgatccgggtcggccgtcgcactcgcatcgtcgagaatgtcggtctgggagatcctcgccaacgcttcgagcgatgaaagcgcggcattcaccgtgttcaggcgcatgggccgcgtcggtttgcgatgcgatctgacgtgcgcgttgattgtgttcgtgcccatgttcgcggtgtcgatgagcagactctcggcgattctgcccacgcgggcacgcacatactgcgcggcggcggcgagcgtcatcgagcgggtttcgagtccatgggcacgcagttgggcgagctcgatgagcgcgaacagcccctgcacgaacggctcgtctgcgagaggccgggtcaccgacgaataccgcaccggcacatcggccccgcgcagcctttccccgaaccgcagcacgtcggcgttgtcatggcagatcacggccatgtcgttccatgtcacgttcctgtcgttcagatgcagcgccgaaatctgccacacgatgttgtcgagttcgtcgtttgccgaccggtacagtctgccgttgagagaaccgtcttccagcaccttcttggtatgcgggtcgttggcatcgagcgggcgcaggcggtccgacccctccacggcaggcagttttccgggccgctgggccaacggcagcgaggattcctcggcggaggctatcgacaggctcacgcgtgacgccacgatgtcccgataggtggcgggctcgtgctgaaatgcctgcaatgaaacatggtcggcggcgaacgggccgttcgggtcgaggaagcgtgcatagaggtattccgggtatgagccgcggaatgcttgcacggcttcgtccggatcgccgaacagcaccaaatgcacgccgagcccctgcagcaccgcgagcaacgccaggccacccaacgtgagatcctgcacgtcgtccaccaccagcaacgtgggcatccaagcccctgcaacagtcagggagcgcatggccgcaagcggcagatacgaggggtccaaacggtattcaccagggtagcgccgggccaccagatcgaaatactcgcgcctcaatgcgagtgccagacgccactgcaacgagaggcgcacgccagcggggccctccgattccacagcttggcaggcgacctgcatcgtccattcctccacattgcgcgcagccgccgtcggctgcatcgcgccgagacgcaacaatgcccccacctcgtcgaagtgggcgaacacgtcgcgcaactgggcgatgaatcctgcattgacgttcgctgcgatatcggcaatcgtctcctcgtcggcatcgttggcatcggcggcatccatcacaatggtcgcccagtcgagcgtgcctgcggacgaggagttggcagcagcacccacccccttccgtgcggggggcgcctgcacgcctgcatcctcgaaataggcgctgagcagccggcaggtctcgcatgagccatcctcgccacggcgatgctgttcgacgtgcacggcgatcacatggcgcaacaatgcgtcctgctcggcaccgttgatgagacggggtgcgctgtcgccgcttctcgaacgggcgatctcaagcaattggaaggccaacgcattgagcgtggtggccgggcgcacacgttcgcttgagccgagttcgcgtatgatccgatcggaatacagatccgcgacgcgacggttcggcacgagcatcaccgtcgacccatcgtccccggccgccaagccggctcgcagcccggcgagcgtcgtctccacggccagctgcgtcttgcccgaacgcggggcacccgagacgagcagggtgcgcgccttggagttccggtcatcattgtgaaccgactccaggaattcacgaatggcacggcgagccccctcgttggtccgcggcgcatcgtcatcggcgaccatgccagcgactccatgctcttgggtatgttcgaccatgcattgcctcctcgccctcatcggcatcctccacaccgattctccaagtgtatggacggcctgcgcgcacgtcaaagaaacgccgtgtaccgagcggtccgtccggattcccatttgcatcgtatcgcggctcatatggcgtgcaatatgttgcagcatgcgatgcgccaacatggtcaatctgcccatattggcgcaaaacgaccaacgaaacgccgcacttcgttgggacagtctcattgccggcttacgcgcaagcagtcgagcgcaaatttcgataatctacatatgggagaatccccgacaccggtacacagccagcgaaggagccgccatgacccagcaggtgccccagccaccgcgccttgccggctacagctatgtgcgcgtgctcgggcacggttccaccgctaccgtctacctctaccggcaacagggcatagaacgcgacgtcgccatcaaagtgagcgtcgagcaggtggacagcagaatcgcagacgccttccgcgcggaggcgcgtgccatggccgcgttgtcgagccacccctacattctctccacctacgatgcgggcgtcaccgacgacggccgctattacctcgtgttcgagtatgcaccgggcggcacgctcaaggacgtgctgtgcaaccatgtgctcgacgtgccgcagatgctctccatgggagtccatctcgccagcgcagtcgccaccgctcaccgggccggcattgtgcaccgcgacatcaagacgagcaatgtgctcatcacctggcaacggttgcccacgctcgccgacttcggcatcgccgtcaccgcctacgatcacagcagcaccggctactccctgccgtgggctcctccggagacgctgcgcacgggcggtgcgggaggtgaggcggccgacatctattcgctgggcgcagtgctctatgcctcactggtgggcacctccccgttcgaatacgggtaccacccgaagacggcgaaggagctggcaaggctcatcatgacgcaaccgctgccgacgatccagcgcaacgacgttcccactgtggtgcatgagacgttggcacacgcaatggcgccgaatgccgacgatcgctacccctccgcactggctttcgcccgcgcgctccagcaggcgcaattcgacctgtatgggcacgccacaccggtgaatgtcgagggcgcagacccctatccgtccagcatcgcacgccggcagatcaccgaacgtccgccggcggcacggcaacgcggcaaacaccgcaaggcgtggatggtcgcgggcttcaccgtcgcgctgctcaccctgttcctcgcggtgttcatggggttcgtgctgcccgggctcgacacccatgccagcggaaaccagacggttgtcgaaggcagccacggcgcactccagaacggcgaacggcccgaacccacgggcaacgagccccccggcgcatccgttgtgccgtcgccgcaacagctttccggcaccctcgacgagaatggcatcgcgcatttccattggaggaatccagatccacgggaaggcgacacctacgtgtggtcgcgtatcggcgccgcgaccacgccgggcgcctcgcatgtggtcgattccaccggctttgacattccggctgaccaaaccgatcaggcgcaggtgtgcgtgcgcgtgagcattgtgcgggcagaccgcagcatgtcggcacaacccgccatcgcctgcgcggtacggaaatgaggtgacatgaccgaatcgccacgcaacagcatgcacaagttctcgccacggcgcatattccgcggtcgcggcaaaacgtggatggtgcccgcggccatgctcgtcatcgtgctcgccgtcatcgcgggagccctcgtcatgcactcggtctcgcaacggcatctgcaactcgacgacgggaccgtctgggtgacctcgcaggccgaccagaaggcggcccgctacaacgtgcggctgcgtgagccggatgcgagcgtcaccgcacagtcgccgaacttcgacatcgcgcagcacggtggagacgtcatcctggctgagccgcaaaaagcctcgggcatcgaccaatccaccatgggtaccgccgacgccaccgcgaccacctccacgatgcgcacgctggtgggtggccgtaccgccgcgatcatcgacgccgaccgcggcgaggtatgggtgggaaaagccgatggcatcgcgcacctctcccccaccacagccaccgcgacgatgaaactcggcaccggcggccgaatcgccatcgccgcggacggcaccgtctacggcctcgacgcccacacggcaaaggtgtacaccgtcggggctggttcgaacacggcgcatgaaatcgtcacactgaacgaaggcgaacccattgccgcggattccttcaccgtggtcgacggccaaccagtggccagcagcggcaaccgcctgtacttcggtcggagccatatcaccgtggatggcgtgggaaccttgacgttgcaggcacctccagccgacaccgacgaccgctcacaacgcggttgggtcgcggcggccgcaccgggcgcactggtcacgatgccgctcaacgagggagccaaacccgccatccaccgcaccgcaggcaccggcgaggccgcacaacccgtgtcggtgaacggatgcgtgcacggggcatggagtcaaaccgcgcgaaactatgccaccgtctgctcggcgaacggcgaacccgatatgctcgatctgcaggcgatcaccgcgacggccaatcttcgccttcgtgtgaaccacaggctcgtcgtgctcaacgacatcgcgaacggcaacatatggaacccggcggattcgccggatgtgatccagattcagtggaagcggctcgacaacgacaccagccgtcagacgagcaccaccaccgatagcacgagttcgaagcacacgttcgcacgggaatgctccacgaaatcagggcagattcgcgcagtggacgacgagttcggcatacgcgccggctccaacaccgtcatcgacccgttgcgcaacgacgagcagaccgactgctcggtgctacgcatcacctcagtgagctcgccggagaatgattcggtgaaggcgtccgccatatatgatggccggttcctgcaggtcagcgcgcacaaccccggccgcgcgaccttcacctatgagatcggcgatgggcgcggacaatcctcaagggcgaccgtgacgctgacgattgccggcgaccagaaccgcacaccaacccgcaaggagcagccggaggaaaccgaggtcgaacagggtgccacgtacaccatgaacgcgcttggcggcttcgtcgacccagacggcgatccgctcaccctggtcggcgccagtgtggagaacaccgacgaggcgacggtctccgcacgcccggacggcgaactcgtgttccacgccggttcgatgcgcgaaggccgtgcagcggtgcggctgcaggtctccgacggcaggaacctcaccgaggcaaccgtgtacttcaccatccgtccgccgcacaccttggcggcgaacatagatccggtctgccgcaccaccacgccgaacacagcagtgaccgtcgatctgtccaaggtcgtgcacgccacctcggccgataccccgcaattgacacgggtagacaatcccgaacgcacgaacgtcaccatgcgcgccaccgacatgtcgttcaccttccagtcgagcgaaccgggcacctatcatgtgccctacacgattgtccaaggcgatgtggaagcctcgggactggcacgcatagacgtcgaacccgaccaggaggaatcggcaaggccggtcgccgccaacgacgtggcattgctcggagccgacaagacggccatcgtggaaccgcttgccaatgacgtcgaccccatgggcggcgtgctggccgtcaccgatgtcagggccgacgccaaatccggcatcaaagcgggcatcgtgggaaataaacgcgtgtatatcacggctcagacgctgccatctgcaccagtgagtctcgactacacagtggcgaacgcacagggcatcgccaccggcaccatcgtggtgcaaccgccggcgctcaccagtgccgattccgtgccgaaggcctccgacatcaccgtacccgtacgcaccgggggcatagtgtcggtggatgtgctcgaccatgtctcgtacaccggtgcctcggccctcgcgctggaccgaaacctcaagactgatgcgggcaagttccgcgggctcgccttcgcctcgtcgaacaccgtacggtaccaagctcccagtacgtcgggtaattacccgctcacctacacggtgaccgatgccctcggcaacgcgtcatcggccgtcgtcaccttcgccgtgcatgacagtgacgcggaatcgaaatccgcgccgaaacccaccgatgtcgaggcgcaagtggctgctggccgaaagatccgcatcccgattcgcgtgaccggcatcgacacggacggcgatgacgtgcagttgctcggcttgggcaacaatgcgcccaaactcggccgcgtgatggaaaccggagcggattatctggtgtacgaggcattcgccgattccgtgggcaccgacaccttcagctacgcggtggaggactggacgggcaggcgcgcccaagcgcaggttcgcgtcggcgtgttccaaagcggcgcggattcgggagtctacgcccgcgatgactcggtgacactgcgcccgggaacctcgaccaccgtgcccgtgctgcgcaacgacatcgcgtctgacaacagcaatcttgtgctcgagaacaacgtgcaatgccaaggcatcgacaacgtgaaggtgcagggcggcatgatctcgctcaccgcacccgaccataccggcaccgcctacatcatctacacggtccgcaacgcagcgggggtcaaggatgtcgggttgctgagcgtcaccgtcgatccgaacgcacccatccaaccgccgagcgcctacgattaccgggtgccggcaagcgccaccgtggacaaaaggacggtgaacgtggatgtctcggcatggatctccaacccgtcaggaagcctcgacgagctcgcagtgaatgtggacaagtccgccgcccagcatgcgcgtgccaccggcgacaccacgctctccatcgatctcaccgatgaggcgagggccattgcctatacggtaacgaacacgacgcacggcatcacctcgacggcattcatccatgttcccgcctacggcgtgttcccgccaaccctacgacctcaggcaccccctctgcgggtcaatgccggggagaccatcaccatcccgcttgccgaccacgtacgcgtaggggccggcaaggcgccgatgctggcgaactcggagtcggtgagtgccacgaaaagcgacaacgacgattatgtggtgaacagcggaacgctcagattcaccgcgagaagggactactccggaccggcatcgatcaccttcaccgtgactgacggcagccggggcacgaatgtgagattcgtcaacacggcagtgatcacattgcccatcaccgtaatcggcaacacgcgtcccgcgccgacgttcgcaggcaccaccgtggatgtcgtcgcaggtgaggccgccacggtgatcgacctcaacgcactggtctcaggcggggcgaatgaggatcggaaaccatactcgttcactggaggtcaatcgtctgcacccttcaccacatcactcaccaccgacggcaaactcaccgtggcggccgacgccaccgccacaccgggtgccacccaatcgattcccatcacgctcgactatggcaatggtgcgctccacgccggtatcaccgttcgggccgtgccgtccacacgcccattggcccggctcaaccccgccaccatcaggctcaaacccggtgaaagcaccggcatcgatgtgactcaaggagcgtacaacccattcccccaaaccccgctgagccttgtttcggcgaacgcggatgcagactccacgctgcaaatgcaaaccgagggaaccgttctgcgtctctcggcgcctccaacaatgccagccgccacctaccatgtggtgatcaccgtcatggatgccaccaaaaccgaggaacgcagcgtaagcgccacgctcacagtcgtcgtgcagaatgttcccggcgccccgttgctttcccccgtggccgcaaaacccgaggattcagcggtaacactcaattggacgaccggcagcgccaacggctcgcccatcaccgactatctggtgagatggcagggaggcgaacaatcctgcggaaacgtgacatcatgccgcatcgggaatctgcacaatggcaccacctatacgttcacggtgcgggcacgcaacgccataggctggtcgccggactccaatgcggtgacgggtagacccaatcgggcaccggaaccccccggacaggtgcaggtgaggggcggtcaccgcagcgtcgaggtctcgtggaacgagccggactacgcaggctcgcgcccaagttcctacaccgtgcaattgcaggggcccgacggttggacgaagacgaacaccagggtgacggcgctcgccacatccttcgagatcgacaacaacgtgatcaccgactcgagcgccttctccgccaccgtcgtggcgaacaacgaagtcggagccagtgtgccgagccgactcgtgtcaacccgggacgtgtggggagaccccgatgccccgcaagtgagcatcacgcaggccaacgaccatgagatcaccggcaccgtgacgctcggcaacatgcgcagggcggggtgcgcctccatccagctctcccatggcacgacatcgtgcgaatcgctgcggttcagggttcccctcgacaatgccatgtatttcaagccgttgagcgtgagcgccaccgtgcacacatcaaggcgtcccgcaactgtggcgacgggacaatcgaacaccatcgagcccaccatcggcattgccgagccaagtgtgcgcatggagggcaggaatgacgagtgcatattggaatggtcggtgccacgcggcaggcatgacggcgttcatgtgaaattcggttccatcgatgcaaacagggagcccgccggcagtgagacagtgcggctcagtccgtgggagcgctgccctgcgggcgaggtacgcacccggctccaaggccattacagcccaccggcacgggcaacgagcacacaccagtaccgtgtggcgccaaccgtcgacgccaacgaaatcgaggtgagctggtcgcagcacaaccgcgatgccatcgtgatgcgcaacacagggcgcgccttcaccgactacggccagcccgtcaccatcaccttgtcgttcagcaacggattcaccacgcgctggaatccggacaccgatgtcacggttcgtccggcacccggcgagagcacagtcccagacaatctgcgctggaccgcaagcatcaccatgaacgaggatgccggctatgccgcacgcaccgaagagcacacggtacagggcattcgccgggcggccacaacccgcacaatcgcctggcacacgacaccacgacttccggcagggcatcacagtctcgagccgcatcatattgcaaaggagaggttccatgacagccaagcatgaacagcctgatgcaccccatgcacagcatacggacgagggctacgaatccaccgtcctctcacgacggggcttccacacgcctgcggacgtggcgccggattccgacgccacccggctgggaggcgtccatgcttcaccgtcgcgaaccgaagtccagacggtcaccgagaccgtgagcaccgtgaatatgccgaccgagcgagatgccaccgcagttcggagcgaatctgctcacaagggcgacattgtgcggttccacagtctgttcgacgccatcgtggcgaacatatcgcaagtggtggtggacaaggagaaaacgattcgcgagtgcgtcaccgccctccttgccggcggccatgtgctgcttgaagacaacccgggcaccggcaagacccagcttgcccgagcgctcgcccaatccatcgacacctcgttcaaacgcatccaattcaccccggatctgctgccctccgacgtggtgggagtcaccttctacgaccagaagaacggcgagttcacgttccgcccaggtccggtgttcgcgtccatcgtgctcgctgacgagatcaaccgagcctcaccgaaaacacagtcggccctcctcgaggtgatggaggagcagcacgtcaccgtcgacgggaccacacatacggtgccgcagccattcatggtgatcgccacccagaacccgatcgaacagctcggcacctactcactgcccgaagcgcagatggaccgcttcctgctgcgcaccacgatcggctacccatccaggacccggagcatgcagttgctcaaggaggccgacatcaccgatcgcgccagcaccatcggcagcgttgtgagcgcccatgacatactcgacatgcgcaaggccgtgcaacaggtgcatatcgacgacgcgatctacgagtatattctgcggctggtggagcagacgcgcaacagcgagctcgtcgccgtcggatcttccatgcgcggtgcgcttgcgctcacccgttgcgcccgtgtgtgggcggcggccgacaatcgcgcctacgtcattcctgacgatgtcaaggatctcgccatctcggtgctcgcccaccgcctgacgctcacgccggatgccaccttcgccggccagagccagcacagtgcaatgcaggcgatcatcgacgacgtgccggtgccgcagacgggactcaacgaagcccacgaatccacgcatggcgagcgctgacatggccatacggaaatacgtatcgccattgggctgggcggtggccggcatgttcgtgctcacgctcgcgttgttcctatgcctgggttgggtggagatgcttgcgttcgcactcgtgtgcgccacgttgctcgtaagctccgcggcgctttcagtgggcaacactgcgttcacggccacgctttcggtatcgaacacgcgggtgagcgtcaaccagacgatgcacgccatggtcaccgtgtcgaatccgagcacctccgtcaccgcgagcgcgagcggcgatctgccgatatcccagagcaactacggcagtctcgagtggcaccatgaacgcttcgccataccgagtctcggcgcccaccagtcgaagcagacggcgattcccctcaccgcaacgcatcgcgcggtggtcacagtcgggccattgtcggtgcgcaaaggagacccgttcggcctggtgcggcgcgagcatcgtctcaccgagcagatccgcgtgtacattcacccggacatcgtgccgctgcacacactgcacgccggaatcatacgtgatctggagggcaatccgagcgacgacctcgtcaatgacgacctgagtttcttcggtctgcgcgaatacgaatatggtgacgacgtgcgcaatgtgcactggctgagcaccgcgaaaacgggaacgctcatgatccggcaattcgaagccacgcgtcgcaccgattcgtcggtgagtcttgacgttgcggcgttttcgtatgcgagcgccgaggagttcgaactcgcggtgagcgtgttcgcctcgattggcgtgcagtgtgtgtcagaacggcgtgcgctgtatgcgcaatccggcagattgcatgtgcagccgcgcaaacccgccgactttctcgacacgtgcagtgagatcgaacctgaaacgcgtgggggcaccatgctggcgaatctggcacgcgaggccctgcttgcctgcgacaaggcatcgctgtactgctttgtcgccggttccgcgcatgaggtggacgatctgcgcaggcttggcgccgccattccggattcggcgacctgcgtggtcgtgcaggtcgtcgccggggcgagcagcgcggtgcgcacgctgccggaatgcgtgttcatcacggtcggcgtgctcgacgaccttccgctactcatggaggtgctctcatgacttcgccgacctcctcctttggcgcgacaagacacggccgcacccgcggcgatgcttcgtggatcaacgacaattccacgcaaatgcccgtctggctgacgatgaacgcccgcgacgcgcgtcgggccgatgccgcacatgccgctggccatgccacacgcgatgccgccatctcacttgtcgtggtgatggcaatcgtactgtgcgcatgcgcgaatctcattgacgtgtacggctcggccggcagctgggcgcgcgccgcgattccggctgcattgctcggttctggcatcgcgttcatgacgctggtgccccggttgaggttctggtggcagattctggcgtccgtgctcgcgcaatgcgtgatcggcccgctggtcgcactgccgcacacaagcgtggcctacgtgctgccgacgtggcagaccctcgccgaaggttgctccgccatgttcacgtcgttcaagttcctcatcgccgtgccggcgccgaccggcaccgcggatggctcgctcatggccgtatggacgctctgcctgctctcgtgcacacttggcggcgtgctggccgtgctcccccaacggcgatggagcgcattgagcgtattggttgtgatcggcgatttcgctgtctgcgcgctgcttggcacatcggcaggcgtgcttcggctgccatgcggcgtggtttgcgcgctcgccgccgtagtctggctgtcgtggcgctggcgactgttcgaaatgtcacgatggctcggtgcgggcgcactgttgctgctggcgggcgccgtggccgtaggcgcatgcctgcccgtccacgccacgcgaacgattctgcgcgaccattacgagccgccgcttgcgcccttcgactatgcgagcccgatgtcgggcatgcgcgcgtatctgaaggagcataaggcagacacactgctcaccgtgcgcaatctgccggcgggggccagcgtgcgtctcgccgtgatggatcggttcgacggcaatgtgtggaatctatcgaacacgcggattgccggcgcatcctcgaactacacgcgcatgggtctgcgaatcacacaggacggcgatgactccggaacctggttcactgccatgttcgacgtgcgcgacggcatgcgtgacgattggctgccgcttgccggcgcggcgacgcaggtcaccttcgccaccaatgcgaatgccgacgatttctactacaacacgggcaccgaatccggtctgctcacttccggcgtacgttccggacttgcctacaccgaaaccggcacgcttgcacgccgtcccagtgatgatgagattcggcagacacaggccgcacgcatcgcgctccccgatgccggcgacattcccaatgccgtgcggcgcatggcggaggcctttgcaggaggtcagcccacggctggcgcggctgcgctcgcattggcgaacggcctgcgcgacaacgggtggttctcgcacggtttggtggacgactacccttcgcttgccgggcatggcaactaccggatcacccagctgctcggcggcaccgcaatggtgggagacagcgaacagtatgcgtcggcgatggccctcatggcgaggtccttgggaatcccgtcgcgcgtggtgcttgggttcgtgcccaaggacgagcatggcgacatcaccgaggcccgcacacagagaaccgagaacggcaccacaaccgacttcaccggcaatgacatcgaagcctgggttgaggtcgcgcttgaagggcacggttgggtggcgttccaccctacgcctcaggagacgaagacccctgaagacaatcagaatcccactcccccgaatccgcagacactcgtgcgccaaccgccactgcccctcaccgatccactgcgcgacaagcaggaggccacaggaagcaccgtgctctccggagacgacgcccaagacccgcgaacctcgggagtctggtcgaaaatcggcgcggtgacgcgcgacgtcgctatatacggctcccccgtgtggattctccttgtcatctgcggctgcattcttgcggtcaaggcggcgctgctcatgcgattgcgcaggaatggcagcacgaatcaccgtgtggagtccggctggcgttcactcacgcaattcgcgatgcaaagcggcattcccgtgcacggcacacgccgtgagcaggcgcatgccatcgcgaggtccttcgccgcggaatctgctgccgaagcgaccgccagcccctccgacacgagccgtgggccggtcaccgaagcgcagctcaggcacagcgcgcagacggcggattatgccgcgttctcgggcaatcctgtgcctgaaagcgaggtcgtacagtattgggagtctgtggatggcatgcgcgccgcattgctgaagaccctgccgttctggcgccgcgtgcgcacgcgactgagtctgcgcggcctattccggcaccatgcatacaaagagacatccgaccaccctgcgtaaaaagggacatcttcgttcgcaaatctgtccctttttacgcagggcaagcagatcaaaccgaacaaacaggtcaagcagaacaagctgccctcttacgcaaggtgggatgcttttatttatgcagatgagtccactatatgcggcggtccggccacacacggcgattgatgctagtatggcggcgtgcgagttgaggaagactccacatgcggagactgtgcgtgggctgcgcatgccgaacatctgcgagcaggaaaggaatctcgatggtggactatcagacggcggtggccgcagtgcaagaccctcaggcagacccgatcctgctcgccaaaatcgcctacgagaacccggagttcggcgccaacgtggcggtgcatccacgcgcctaccccggactgaagcgctggctcgccgaattcggcgacaaacgggcgcgcatgacactcgcgcagatgggcgtcatcgccaccgcagaccctgtagaagaccgcttcgacgagtcggagaccccgtctggacagcggaaccccgaaccggcgcgcgccgtgaaactcgccgtggaacaactggtgcgcaattcgggcgcgcagcaaccagtgcaggcgcgccccacgcgattcacccagccagcgcaatctacgcaggcggcacagcacacgctggcgacgcagcctgatcgggcaacggcgagcaatccgaatgcgcagtacagtgcgaatggcgaattcacgccgcagctggccatgaccacgtctgatccggcggtgatgcacgacatcgcccagtacgcaccggatctgcatgtgtatctggtgcaaaatccgtatatctacccagaattgctcaactggctggcttcgctcaatgagacggaggtcaacgaggcaatcgccgcacgccgtgcacgttagagggcaacgccagttcagcgggcatcgagtgtgaagaactggtcgcctatgcgaatgttcgcaggcagatcgagctccaccggcataccttggctcacgcgcatctcctcgtcgtcatgcacgacgtacgtgccgttgagggagcccatgtcttccaaccagagcgtgccatgctcgccgtagctgatcgcgcagtgattgcgggagaccgtacgcgtggggtctatgagccgcaccgatttcgaaccttccggaatgtcgtgcgacggcttgcgcccgagtaacgtgttcatattgatgtcgatatgctggttcgtcaccgcattcgtcaacaccgcttcgcgttcggtttcgcgtgcgaatcgtttggagagcacggtgccgtcccactgggcatcgccttccgaacccggttccgccgtgtactcatcgggttccccggcgtagtcatctggctcgccatgccattcgggctgctcactcacttgtccatcttgtctatgcgcctgcacacggcgcatctcctgcgttccgtacgcggggaacgcgacccccggcaccgcgtcgacgtcatcgtcataccaacccggctccggtgccggtggatacggaattctgctcatacccatgttgtaccacaccgcggcacattcccggcttcgatccccattttttgggcagattccgcgcccgcatacagtgaaaggtccccacacccgccatgggtgtggggacctttcaggtcagacgtcggctcggactacttgagttcgtccgggtcgatgcggaactcgtctccgaagtcgaccgggttgtcgttgtcgtcgaggaagtcgtccgggttgaagtcgtcgccgagcttcagatcaccgaaatcgatgttcgagaagtcgacgtcacccagatcaccatcgctgaggtcaccaccgagcgaaccgtcgcccaggccgaagttcgggtagatggtgtcgcggatcgccttgtcgggctccacggtcgcgttgcggtagcgcgccagaccggtgccggccgggatgagcttgccgatgatcacgttctccttgaggcccttcaggtcgtcttccttctcgttcagggcggcctcggtgagcactcgagtcgtttcctggaacgatgcggcggacagccaggagtcggtcgccagcgaagccttggtgatgcccatgagctccgggcggcccgctgctgggcggccaccggcggcgacggtcttcttgttctgctcgcggaagcgtgcgcggtcaacgagctcacccggcagcaggtcggtgtcaccggaatcgatcacggtgacgcgacgcagcatctggtgcacgatgacctcgatgtgcttgtcgtgaatgtcgacgccctgcgaacggtacacgtcgtgcacctcgttcacgatgttcatctgggcggcacgcggtccgagaatgcgcagaatcttcttcggatccacggaaccctcgaccagctgggtgcccggatcgacgtgctggccgtccttgacgagcatcggcgcgcgacgggtcacctgataggtgatgggctcgagcgagtcgtcgtccggctgcagaatgacctcacggccacgctcggtgtcctgcaccttgatggtgccggcaaactccgagatcggcgcctcacccttaggcgtacgggcttcgaacaactcggtgacacgaggaagaccctgcgtgatatcggatgccgaggcgacgccaccggagtggaaggaacgaagcgtcagctgcgtgccaggctcgccgatggactgtgccgcgacgatgccgaccgcctcgccgacgtcgacgagcttgttggtggccagcgaccagccatagcacttcgcgcacacgccgcgcttggattcgcaggtgagcacggagcggccgatcacctgctccacaccatgtgccacgaggtcgttgagcacgtccatcgagagggcgtcgcccgcgtggtacagaacggtcttgccgtcggctgggtcgagcacgtcctgagcgagcagacgcgagtacgggccgccgtccgccgccttgacgagcacgagattgccgttctcgtcacgctcggcaacggtcatgggcagaccgtgcgtggtgccgcagtcctcttcgcgcacgatgatctcctgggagacgtccacgagacgacgggtgaggtagcccgactcggcggtacgcagtgccgtatcggccagacccttgcgggcgccgtgctgcgagatgaagtactcgagcaccgacaggccctcgcggtagttcgacttcacaggacgcgggatgatctcgcccttcgggttcgccacgagaccacgcatgccggcgatctggcgaatctgcatccagttgcctcgtgcaccggactgcaccatgatgttcacgttgttgtcgtcatggaagttctcgcgcatggcttcggcgaccttgtcggtgcactcggtccacaggttgatgagctcctgacggcgctcctcctcggtgagcaggcccagatcatactggttgttcaccttggcggcctgtgcctcatagcccttgatgatctcctcgcggtccggcggggccacgatgtcggagaacgccatcgtgacgcccgaccacggtgcgcgggtgaagccgagatccttcaatgcgtcgagggtagcagccacctgctgggtggagtaacgggtcgcgatgtcgtcgacgatcttcgagagcttgcccttcggcgcctgctcgttgatgaacgggtagtccaccggcagcgtgtcgttgaacaggatgcggccgagggaggtggcgaacagcacggaaccgtctgcgaaacgctcctccttcaccacgtccgggctgcccggctccgggtcgatgacctggacctcgcccggctcccaatccttcggcagcacgaagtcctgcggcaggcggatgagcaccttggcctgcatgtcgatctcatgcttgtcgagggccatctgcgcctcttcgagcgacgagaagatgcggccctggcccttggcgccgtcgatgacggtcgacaggtagtacaggccgaggatcatgtcctgcgaaggcatggtcacggtgtggccgtcggcgggcttcagaatgttatcggaagccatcatgagcgaacgggcttcggcctgggcttcggcggacagcggcagatggactgccatctggtcgccgtcgaagtcggcgttgaatgcggcgcaggccaacggcggaaggtggatcgccttgccttcgaccaagatcggctcgaaggcctgaatgcccagtcggtgcagcgtaggtgcacggttgaggagcaccggatgctcggagatgacctcttcgagcacgccccacacctcggaatcaccgcggtcgacgagacgcttggcgctcttcatgttctgcgcatagttcaggtcgacgaggcgcttgatcacgaacggcttgaacagctcgagtgccatcggcttcggcaggccgcactggtgcatgcgcagcgacgggccgaccacgatcacggaacggccggagtagtcgacgcgcttgccgagcaggttctggcggaagcggccctgcttgcccttgagcatgtcgctcagggacttgagtgggcggttcgaggcaccggtgaccgggcggccgcgacggccgttgtcaaacagcgaatcgacggcttcctggagcatgcgcttctcgttgttgagcatgatctccggggcgccgagttcgatgaggcgcttcaggcggttattgcggttgatcacacgacggtagaggtcgttcaggtcggacgtggcgaaacggccaccgtcgagctgcaccatcgggcgcagatccggcgggatcaccgggatcacgtcgagcaccatggcctccggcttgttgtcggtggtcaggaaggcgttgacgaccttgaggcgcttgagggcacgggccttgcgctggccggtgccagtctcgatctcctcgcgcagctccttggcggcggcttcgaggtcgaagtcctgcaggcgcttcttgatcgcctcggcgcccatgcagccttcgaagtaatcgccgtagcgatcctccatctcacgccacaggtccacatcggactccatgtcgcccggcttgagggacttgaacttgtcgaacaccgcggcgatgcgcttgatctggtcgtcgtaacgctggcggatggccgccatgtcgcgttccgcgccgttgcgcagcttcgtcttggcgctgcccttcacctcgccgtccgcttcgagttcggccaggtcggcttcgagcttcttggcgcgctcctcgatctcgttgttgcggcgacgttcgagattctgcacctcgtggtcgaactcgtcttgcagatcaggcagatcctgatgacgctgctcctcatccaccgaggtgaccatgtaggaggcgaagtagatgaccttctcgagttccttcggcgcaatgccgagcagatagcccaagcggctcggcacacccttgaagaaccagatgtgcgtcaccggggcggcgagctcgatgtggcccatgcgctcacggcgcacgcggctacgggtgacctcgacaccgcagcgttcgcacacgatgcccttgaagcgcacgcgcttgtacttgccgcaggcgcactcccagtcgcgggtcggtccgaagatctgctcaccgaacaggccgtccttctcgggcttgagcgtacggtagttgatggtctccggcttcttgacttcgccatagctccaaccgcgaatgtcgtcggcggtggccaggccaatcttcagtttgtcaaatgcgttgacgtccagcacgtaatatcctgtctgttgaaaatcgtcttgttcctagcacagctgtgcgggagtgcccgttcagcggtattccggttcgtcagcgacctggtcggccttcgcggcggcgtccgggcgggcgccgatgttgaagccgagatcgttggaggaggaaacaggatcgtcgtcctcgtccttcatgtcgatggccacgccttcggcgttgagcacttcgacgttgagggacagcgactgcatttccttgagcagcaccttgaacgactcggggatgcctgcaggcggcaggttgtcgcccttcacgatcgcaccgtacacacgcacacggccatcgacgtcatcggacttcgtggtcatcatctcgtgcagcgtataggcggcaccgtaggcctcgagggcccacacctccatctcgccgaagcgctggccgccgaactgggccttgccgcccaacggctgctgcgtaatcatcgagtacgggccggtggaacgcgcgtggatcttgtcgtcgaccagatggtggagcttcagcatgtacatgtagcccacggagatcggcttcggatacggttcgccggtacggccgtcgaacagcgtcgccttgccgttgtcgccgacgagcttgttgccgtcgcggtcggtcagcgtcgtggaaagcaggcccttgagcacgtcctgacgcacgccgtcgaacaccggggttgccaccggggtgcccggctcgcccttctcggcgcccttcggcaccatcttcttccattcggcttccatatccggatcgagggagatgtcccagccggcatgggcgacccaccccaagtgcagttcgagcacctggccgaggttcattcgcgaaggcacgccgagcgggttgagcatgatgtcaaccggggtgccgtccgccaggaacggcatgtcctcttccggcagaatgcgggagatgacgcccttgttgccgtgacggcccgagagcttgtcgccctgggtgatcttgcggtgctgcgcgatgtagacgcggatcatctggttcacgccgttcggcagctcgtcgccgtcctcctcggcatcctcgcgcgtgatctccttgacggcaatcacggtgccggtctcgccgtggggcacgcgcagcgaggtgtcgcgcacctcgcggctcttctcgccgaagatggcgcgaagcagacgctcctcaggcgtgagctcggtctcgcccttcggggtgaccttgcccacgaggatgtcgccggcctcgacctctgcaccaatgcgaatgatgccacgctcgtcgaggttggccacggcgtcctcgcccacgttcggcaggtcgcgcgtgatctcctcggcgcccagcttggtctcacgggcgtcgatctcgtactcctcgatgtggatcgaggagagcgtgtcgtcctgtaccagacgctgcgagatgatcacggcatcctcgtagttgtaaccgttccaaggcatgaaggcgaccagcaggttcttgccaagcgccatctcgcccttctcggtggccgggccatcggccagcacggtgcccttctccacgcgttcgccgtcgtggatgagcggcacctggttatagcaggtggtctggttggagcgctggaacttggccagcttgtagctcgaggtcgtgccatcgtcgttcatcacacgaatgatgtcggcggagacgtaaatgaccacgcccggcttctcggccagaatgacgtcgccggaatcgacggcggcacgccattcggcgccggtgcccacgagcgggcgctcggacttgatgagcgggacggcctgacgctgcatgttcgtacccatgagcgctcggtggccttcatcgtgctcgaggaacggaatcagcgatgcgccgaccgacaccatctggcgcggggagacgtccatgtaatcgaccatctcgaccggaacgtcctccgcctcgccggcggcgtcacgcaccaaggcttccttctcgacgaagttgccgttctcgtcgagcttctggttggcctgggcgatcacgtgctcgacctcgcggtcagcggtcatgtagacgacctcgtcggtcacatggccgttctcgaccttgcggtacggggtctcgatgaagccgaaggggttgatgcggccgaaggtcgccagcgagccgatgaggccgatgttcgggccttcaggggactcgatcgggcacatgcggccgaagtgcgacgggtgcacgtctcgcacctccatggaggcgcggtcgcgcgacaggccgccggggcccagcgcggagagacggcgcttgttcgtgacgcccgccaacgggttgttctgatccatgaactgcgagagctgggacgttccgaagaactccttgatcgtcgcattcaccggacgaatgttgatgagtgactgcggcgtgatggcctcggcgtcctgcgtggtcatgcgttcgcgcaccacgcgctccatgcggctcagaccggtgcgcagctggttctggatcagctcgcccacctggcggatgcggcggttgccgaagtggtcgatgtcgtcgacatccacgcgcagctcgacgtcctcgccgtcacgcttgcccgggaaggtggcgtcgccggcatgcagcgtcacgaggtacttgatcgtggcgatgatgtcttcgcggctcaggctgcggtcgttgtaatccttctccagaccgagcttgcggttgatcttgtagcggccgacgcgggccagatcgtagcgcttcgtgttgaagtagaaggagtcgagcagtgtgcggccggcttccggcgtcgcggcatcggccggacgaatcttgcggtacaggtccacgagggcggcgtcctcagagtcgatggtctccttctcgagggcatcgagcacgagcgggtaatccttgaacgcgtcgcggatctcgctgcgggtcatgccgatcgccatgaggaagacgatggccgactgcttgcgcttgcggtccacgcgcactccgaggaagtcgcgcttgtcgatctcgaactcgagccatgcgccacggctcggaatgatcttggcgccgaagatctccttgtcggaggtgcggtccggctgacggtcgaagtagacgcccggggaacgcacgagctgggagacgatcactcgctcggtgccgccgatgatgaacgtgccgtgcggggtctgcagcgggaagtcacccatgaacacggtctgggacttgatctcgccggtctcgccgttctcgaactcggcgttcacgtacagcggcgcggagtaggtgtagtccttctccttgcattcctgcacggtgtggcgcggttcctcgaagtatgggtcggagaacgtcaggctcatggtctgtgcgaagttctcgatcggggagatctcgtggaacacctcatcgagtccggagacgtgcggcacggtgttggtgccgttcgcctcgtcttcctccacgcgcttcttccagcgctcgttgccgacgagccagtcgaagctgtcggtctgcacgccgaggaggtacggcacgtcgatgggttctttgatggagccgaaattcacacggtccgaagccttgtgcagatcgatgtcatgctgatctgcgcgtgcggtgacggaggtggtattcgtcgtagtctgtgacaatggacgttccttaatcgctcactttggtcggtgtattgttaaggaagcgcgagggggccgccatatgcctgcacacgggcgcttcgtctggcagactgcccgctatatgacaatctatacgcaaagacaataatttagcagactcaactcgaaaacgcaaattatattccctcgcacagtgcccggcgtgtcgcatgtgccgatctgcacgaaatacccgaattcggcggtgtctactccacggtgatcgtctgcggtttgctctgcaccttcgggtcgtccttgaggctgagctgggccacatacgtgccgcgatcgaccttcggcaactggtcgtcggccacacaggaggtgcccgtgcggttcgtgttccacgcgatcttctgctcgtcggtgacgtcggcgaagaacaggcgcgggcggtatgccgcctcgcacacatcggaacgccagatcacatcggaacccgaggtgatcgtaagcaccagactgtcggcggccgtgttcatgcggcatccttcggggcttttgcccacatacgcgacccgttcggtgaagtcgagcgagccacccacgccgacggacgtggcatccggcacgagctgcacatccacatcaccgggcgtgcacgtctccaccttgctcctctgcggcgcggcaggcacctcggcacggctcagcgcaggcgcggcggaggcccccgccatgccatgcacgctcaccgcaccgcgcaccagactgtatacggtgaacacggcgagcgccaacaccaccgcaagcgccgagaagaacacgatgcgacgccggcggtacaggcgcttgcgttccgctgcggtcatgcgctttctgccgccggtggtgcgcgtcgtgccacggcgtggcgattgtggtgagctcatgctcccagtctaccgagcgcgctccccgttgctgtcccccacgagctgcactactccttactggtcattcctgcagccccatatcacatctatctcttacgggatgtcggtaattcttacgggatgtcatttatgtacttgtgtgagcaatgtcttcgacattttggaggtgtcatcggcgaaaacagggcttttccgtcttttagccggatgtgccgcagcggtgaaagcggcatcccgcaggagaagggtgacatcccgtaagaattaccgacatcccgtaacgattgaagacatcccgtaaggctctgacacactacgccggcagacgcatcgcgtggccgggcagaatctcaatgaggccgtcgtcgtccaatgatgcgatgcagcggtcgagctgcacggcgtccgcacacagtccctcggcctgcgcatgcgtgagcgcaccgcccgccggcaacgcgcgcaaggcctgcagaatgctgccgcgcacctgcctgtcggtgccgtggaaccgctgccgcggccgtgtgcgtttctctccgagcccgggcatgccggccttcacgaactcgcattgcggttgcagcgggcactgttcgcactgcggcgccttcgccgtgcacacgagcgcgccgagctccatcaccgcctggttccacagcacggactgctccgccgccttcggcagcactacccatgcgagcgcgcgctcgagcggtgtgcacgagccgcccaaggattccacgccaaggaacgcgcggctcagcgcgcggcgaatattcgtatcgatcacggcgacacgctcgccgtatgcgaagctgagcaccgcgctggccgtgtaatcgcccacgctgggcaaggccatcagctcgtcgtactcacgcggcaggcggtcgtcgtagtcgcgtgccaccacttccgcgcactcctgcagtcgcagtgcgcgacgcgggtacccgagacgtccccatgcgcggatcacctcggatttctctgctgccgcaagcgaagcggcgtcgggccattggctcatccatgcctcccaatacggcacgacgcggctcatctgcgtctgctggctcatcacctcgcagacgagcacgccccatggcgttgtgcgtccgtaccgccagggcaagtcacgtgccgaggtctgccaccaggtggcgagttcacgcaatgcctgccgggcgctgcgttcgagttcgcgggcacgccgctcgcccacggtctgctcgggcgtggcctgcgcgcgtttgcgggactttgtgcggggggaggcatctgccatgtcggaaaccatagcgcaacatcgtaccgcagattgccccgacctgcatggccgaactgtcgattgaccgcaatacgctgtgaccatgaccgcacattcccagaatccgcaggaaatccccgcacagcacgccgatcccgaagcccaagtggagaagatgttcgaatacggttaccgcaaatcgaattacggaccggatgaactggtcaccgacgcgcacggcaacccgatttccgtcaccgatgcgatgatgacggcccgcgaggccgccgagacgccgacgaccacgccgcatctgtgctattacagcccgcgcatccccggcaacaccggctcggcgatccgcctgtgcgcggtcaccggcacgatcctgcatctggtggaaccgctcgggttcaatctgcgcgacaccaagctgcgccgcgcaggcctcgactaccacgacatggcccatgtggtgttgcacccgaatttcgaggatctcgtggaatcgatgccgaattcgcgcatcatcgcattcaccgcgcacgccacgaagctgtatacggaggtcgaatacaagccgaccgacattctgctgttcggcccggagcccggcaatattcccgacccaatggacatcatggccggcccgcatgtggccgaacaggtgcggctgccgatgcgtccgagcctacgcagcctcaacctgacgaactgcgcttccattgccatctacgaagcatggcgccagctcggtttcgacggcggccagtgatcacgccgcacgcgccaatcctgatctgagactgggattgcaaaacgagacatgcaccgcaaacatgaacgcgggcacggtattcgaataccatgcccgcgtatgtgcaagctgaaacggccgctcagttcttgaaactgtggatcggcgccggaatgcggccgccgcgcgtcacgaacgcctcacagctcgccgtgttcaccggcatgatcggcgcatagcccatcaatccgccgaagttggccatctggcccaccgtcttgcccacgacaggaatcacgcgcacggcggtcgtcttctggttcaccatgccgatcgcagcctcgtcggcgatgatgccggagatcgtcgacgcggtggtgtcgccgggaatcgcgatcatgtcgagaccgaccgagcacacgcaggtcatcgcctcgagcttctcaatggtcaggcaaccgctttccgcggcgtcgatcatgttcttgtcttccgaaaccggaatgaacgcgccggagagtccgccaacgtacgacgacgccatgatgccgcccttcttcacctggtcgttgagcatcgcgagcgccgccgtggtgcccggagcgcccacctgcgccagaccgatcttctcgagcacctcgcccaccgagtcgccgaccgccggagtcggcgccagagacaggtcgatgatgccgaacgggatgccgaggcgcttcgatgcctcctgggcgacgagctggccgacgcgcgtgatcttgaacgcggtgcgcttgatcgtctcgcacaggaattcgaaatccttgcccttggctgcatcgagcgcgcgcgagacgacgcccggtcccgacacacccacgttgatcaccgcgtcgccctcggtcacgccgtggaaaccgcccgccatgaacggattgtcgtcgggcgcattgcagaacgcgacgaatttcacgcagccgtacgaatcgatgtcggcggtcgcttcggcgatctccttgatgatgtggccgagcagctccaccgagttcatgtcgatgccggtcttcgtggaacccacgttcaccgacgagcagacgatgtcggtctcgctcagcgcggccggcagcgagcggatgagcagttcctcggccggcgtcatcgacttggagacgagcgccgagtagccgccgatcagatcgacgcccaccgttttcgccgcgcggtcaagtgcgtgggcgatctgcacgaagtcggcggaggtcttgcagcagctggcgccgacgagcgcgatcggcgtgaccgtgatgcgcttgttcacaatcggaatgccgaagtcgcgttcgattgactcgccggtggacacgaggtccttcgcatacgaggtgatcttgttgtagatgaggtcgcaggtggtctgcagatcggtggacacgcagtccatcaggtcgatgcccatcgtgatcgtgcgcacgtcgagcttctcctgctcgatcatctggttcgtctcatgaacttccagaatattcagcatagtgttccttttcgcagtctaaatcgagaaaccgaatgcggcgctcacacgcggtgcatcttcgtgaagatctcctcgcgctggcagcggatgcgcacgccgatctcctcgccgagctcctcgaggtcgttgacgatcgtctcgaaggagacgtcggcgtctgcatagtcgacgatcatcatcatgttgaagaagccgtcgatgatcgtctgcgagatgtcaagcacgttcgtgtggtggtcggacaggtacgtgcacacgcgcgcgatgatgcccacggtgtcttggccgacgacggtgatgattgccttgttcatggaactccctgctcggtttttcattcgcttgcgcttgcgacacgcgcacgcccaacgtgttcagtatagggaaaacacaggccatacgcgtgcgtctgctcattttcgcaagactatttccccgctattttctcgaacgcaggtgcgagccatgcgcatgcgtcttcctacgccgccgctgcgtgatcacgatcgtcgccatgcacacggcgacgcccacgatcacgaacgcggtgatcgcgatatcgctcatgatcgcgcgctccgggttcacctcgacctctttcttgttctcgggggtcggaatgcggtgcgcggtgaggatcaggcggtgcgagttcacgccgtacggcgtgcaggtgaccagactcaccaagtcacgaccctcctgaatggcgagcggcttcacgttggtcggcagcaccacctggcgttcctccacttcgtaggtgagcacgtcgtcgtacacggtgatcgagaacttgtcgcccttcttcatgccgtcgatgccggtgaacagctgcgcggacggcaggccggtgtgcccggtgatcaccgcatgcgtggattcaccgccgatcgggaagctcgagccctcgtaatgaccggctgcgatctgcagcaccgtctcgtcggtgccatggtagatcggcagcttcgcgtggatcgccggaatcgcgatgtagcccatgatgccggtgccggagacgtcgagaatcgaattgtagactttcttctcctccccgttcggcaggaagcgcgcattgccctgcccgagcaggttctcgttgtattcgcgcgccttcttgatctgcgcctcgcgatcttccttcggcgtgttcgccacctgctcggagtagccggcgatcgcacgactcgacacatggcggttccacgcgtcggcgacggtggggtacacgatgaggcccacacccacgagcagcatgatcaccatggagatgatcatgagcatgaaccggcggtttgcacgctttttacgcttcgcctgtgctgcggccgcaacgggggtccatctcggtgacgccgttcgcctgcatatcgttgccgttcttcggtgttctcgccatatgctccctcgctgtttcgctctgagcctagtgtatcgaataccggcggcggaggcgactgatatggcgaatgcttgcagacccttttcacttccctgccccatgacgacacacaagccgccatgctgggcacggcggcttgtcgagagggcatctgcgagcagatcactgcacgcggtgcgccgaggcggacgcctgcgcgggcaaggcgcgcggcaaaacgaatccgcggcgctcgaactcatcgcagatcgcctgcgcaatgcgctgagattcacccgcgttcacgagcgcgatgatcgaaccgccgaatccgcctccggtcatgcgggcaccgagcgcaccctcgtcgcgggcgacatccacggccacgtcgagctcgggcacggtcacctcgtaatcgtcgcgcagcgagtcgtgcgatgcgttgaacagttcgccggcggtctgcatgtcaccttccgcgaaagcgcgcacgaaatcgtccacacggccgatctcggtgaccacgtgacgcacgcgcttcctcatggtctcgtcgtcgagtcggtcgagcacgccgtcgagcgcggcggcaggatccgcctgcgcattcaccagatctgccacctcgcgcagattcgcgacgcccagaatgcgcgcggcctcctcgcaggtcgcacgccgctgggcatactgtccgtcgttgagctggtgcggcgcgcgcgtgtcaagcacgagcagctcaaggccgtggccttcgaggtcgaagacctcctgctgcacgctgtccaccgcgctcaggccaggtcggcaatccaaacggattgcatggtcgggggtgcagcgcatcgacgcgttctggtcaaggccaccggtggaggcgcccgccatgtcgttctcggaggcaatcgccgcgttgatcaaggtcacacggccttcgtcggtatcgccgaagccctgtgaatacacgtcgtcgagcgcaagagcggtggagcaggtcatcgcggccgacgagctcaggccggaaccgagcggcacgcacgagctgaatgccgcatcgaaaccctgcacgccgtcgaaaccggcattgcgcaatgcccaggccacacccaccgggtaggcggcccaaccgtccacgccaccggcttcaagcccgtcgaggtcggcctcggcaatcacatcggaggcgaggtcggaaacaacgcgcacgctggtgtcgtcacgcggcgagagcgctatataggtgcggtgcggcagtgcgatcggcaggcagaggcccgcgttgtagtcggtgtgctcgccgatcagattcacgcgccccggtgcggcccacacgcctgcgggctccttgccgtaggcctgcttgaacagttcggcggcccgtgcggcgccctcggcgtcgctcattggctcgatgaattcgactgatgtcatggaaagccctttcaacaagtacttcggattccaaatgtatgaattgatatgcgttgcgctgcgcggtcagtcggcgatgtcgacggggccgagctcgtggaatcgctgtgcgatgagctcgggcgtggtgtcggagacccatgcggccatgcccgactccgagccggcgaggtacttgatcttgttcgcggcgcggcggaacgagaagaactgcaggttcagccggtagttctcgcggcgtgcgtctcgcacgggggcctggtgccatgcggcgatgtacggcaggtccatgcccttgccgtcgcccttgtcgaagaagcggttgccgcgcctgagcagcgtcgagtacatctgcgcgagatcccagcgctcggcgtcgttgagctggtcgagcgtgagaatcccgtcgcgcagcggctgcacatgcacctcgagcggccatcgtgcggccgccggcacataagccacccagctgtggttgcgcatgatcacgcgctcccccgcatcgatctcggcgtgcatcaggtcacgcagcagattgccgccggtgcgctcgaaatacgcctgcgtatgctgcagctcggtctccagcttcggcgcgatgaacgggtacgcgtagatctggccgtgtgggtgggcgagcgagacgccgatctcctcgccgtggttctcgaacgggaacacctgctcgatgccgtcgatcgcgctcagctcggccgtgcggaaggcccatgcctccaccaccgtgcgcagacgttccaccggaaggtccgccggcagcccgttctcgtcggagtcgaagcagatcacctcgcaacggccggccgccggacgctcctgccacagcgggttgccgtccacatagcgcacctcgttcggcactcccggcacctgcaccatcgacgggaagcggttttcgaacaccacgacgtcgtaatccgtgtcgggcacctcgccgtcctgatacgggtcgcccggcttgcgcgccgccagaggattgcctttcgccgtcgcgcccgcgcctgcagtaataggcctgttcatgcgtgccgtggccatgggaatccagtctccggtgagcgggtcgcggcgcatctgcggtgccgcgtacttcacttccacaccctcggcgttcaagtgcggtgcgaagcggtagtccaggtcgcgcgggtcgtcgagcacgcgcgtcctgctgccgttcacatactccggctcgtcgtcgaggtagaagaaatcacggccgtccgacagcgtggtcggcgtgatgcgcagatgttccgcggcgtattcgccgggctggtaatgcgcgaattcgggctggttgggtgtctgtgacatcggtgtcatcactcactttcctcttcggtttcgatctgatgggcgagcacaagctccttcaccagatcgcgggtctttgcaacggaatccgggtcgagaccgtcgtcggtgatcaccgtgtccacctggtcgaatttggcgaacagcgacaacgatgtgctgctccacttcgtgtggtcggtgaggatgatcgtacggtccgcaatgtccatcatcgccatgtcggtcgccgcttcgagcgagttcggcatgaggaagccgcgtggcatcgagaccgaatgcgtgccgaggaacaccgtgttcacacgcagcgaggcgatcaccttgtcggcgatcgggccgacgagcgaattcgaacgagtgatcacgccgccggtgacgatcacctcgacgtccttcgattccagcgcctgcacgagctcggccaccggaatcgaattcgtcaggatcgtgatgccgttcgcgttgggcgattcgagcagatgctgcgcgaacacgtacgcggtggtgccgccgccgatcgcgatgacgtctcccggtgagacgaatttgatcgcctcgcccgcaatcgcatccttcaggccgatgtccatctgcgatttcaccgagaacagcggctcgctcagcagcgtgctggtggagaccgcgccgccgtgcacgcgcctcaacagtcctttgtcggccagttcggcgatgtcacggcgaatcgtcatcgccgagacgccgaactccttcgataacgcggtgatgcggacggcgccgcgcgtacgcaggcgccccagaatcagatgctgacgctgtgaagaaatcatgcgaacattatcgcacatcttcttccaaagaacaacttgaaacgaacatttcggcgtgtttaccacacaacaccgaacaaaaccgcatatatcgcagaattgcggattccctcgcccacgccgcgcggcgcaccgctactcgcgttccatatactcctcggattgctcgggatcatcctgagccaggcccgcatcctcacgcatcagctgcccaggcagctccagatcgtcctcgacctgccgttccatccgctcgttgttgtgcagaatcgtctgctgcatgcgcgtgaagccccactgcgtcaccttacgcatcgcctcgcgcacaatggagccatccatcttcgagtcgcccttcgtgcgatccggaaacacgatcggcacctccaccacatgcccgccggcggcgatcacgcggcgcgtcatatcgatctggaacacgtagccgttcgcatcgatgccgtcgaggtcgatctgccgcagaatcctggagcgatatgcgcggaaaccgctcgtcatatcgcgcaccttgagcccgagcatcacgcgcgcgtactgcgaaccggcacgcgagatcacgtcgcggtaccatggccagtcctgcgtggagccaccgggaacgcgccgggagccaagcaccagatccacctgcgggtgccgctcgagcacgtcgatgattgctcgcagatcctgcggcctgtgcgagccgtccatgtccatctcgcacacgatgtcgtacctatggccaagcgcccattcgaatccctgaatgtacgcggtgcccaatccctgcttgccggggcggtgcagcacaaagacgcgcgaatccatcgtgcacgaggccagtctgtcggcgatcttcagatcctgggtgctcacctgcgtgtcggaatacagcgaggaatcggaatcctcatctgcaaaactcacatcgcgcagtacatcgttctcgttatgctccacgttgagatcctgcggcagccgcgtcacgcgcgagattacgtcggcgagcgtgccggtgccgtcgggcgagttgtcgtccacgatcagcacatccacgccggcattgcgcagaaagaggtcggtgagcgtgggctccagattgtcacgttcattgtaggtgggcatcaccacgcacacacggtgcccgctgttcacctgcgccatccgcacgccctcccgtcattcgagcatccgttattcgaccgtcttcattgtaggcatacgccgtttccccagcactctctcgcagagcgcgaattcgcacgaagcgggcgaaatgcggggcgggtgcatgcaggcatgcatttttgccccatcaatggcacaatggtgtgcatggcttatgtatctcagaacggtctgcacgactcgatcaacaaggcgaccaccgacctgttcacgttcgcatacaagcatgtgatcaagccggatctcgtgttcaaccacacgcccgacatcgcccacgaccaaatgatccgcttctgccagatcaccggcaagatgccgccgctcatgtggctgtgccgcacgatgctcaactacaccgacccgattctcgaaacgaatgtgatgggcatcaacttcgccaacccgttcggcctgtcggccggcctcgacaagaactgcgacatggccgccgtgctcgaccatgccggtttcggcttcgagacggtcggctccaccacttcacgaccctgcgccggcaatccacgcccctggttccaccgtctgcccgaatacgattcgatgatggtgcacgtgggcctggccaacgatggttccgacgtcgtgatcgaacgcgccgaagatgcctggcggcgcacgcagagcatgcagctgagcgtgtcgatcgcacgcacgaacgacgaccaggtgggcgatctgaacgaaggcatcgaagactactgcatctccatggagcgtgccgccggccgcaccgcgatggtcgaggtgaacgtctcctgcccgaacaccaccgtgggcgagccgttcaccgagtccgccgagaatctcgacaagctgttcgccgcgctcgacagaatcgaacgcccgcagcccacgctcgtcaagatgccgctcaacaagccgtggccgcagttcaaggaattcctcgacgtattggccgcgcacaacgtgcagggcgtgaccatcgcgaatctgcagaaagaccgcaccggtctcgacgacatccccaaggattggctcggaggactctccggcggcccctgcacagtggcgagcaccgagctcattcgcagaacctatgccgagtatggcgaccggttcgcaatcgccggcgtcggcggcgtgttcacccccgaacaggcctatgagaagattcgcgccggttcctcgctcatcatgttcatctcgtcgctcatgtaccgcggcccgcagcagatcaccgtattgaagcgaggactcgcgaaactgctgcgccgtgacggcttcggaagcgtcgccgaggccgtgggcgtcgacgcctgatttgtccttcagcttccgctggccgcgggatggggtactcggatgacccatggaatgattgttcagcgaacagcatgcaccttcatcggtaccagcgtggtcggttgggtctgccgattggctgaggaacgtaaaggacgcttgcgatccagtgacgaaatcaaccggcaggcccaaccgaccacatactattccactttccgtcctcggctttttgccgtccctcttccccacggcctctgacatcccgtaacgggctttccctgttacgggatgtctcttgcgacaacgagggccattactcattacgccatgcgccacgcacgtactgtggcgggtatggcaacaggtcggtcggctcaccaagcttgaagccggcacgcaacggccagtacggctcgcgcaatgcggcgcggccaatctccaccgcatccgcctcgcctttggccagaatgcgcgcggcctgcttgggcttggtgatcaatccgaccgcggtcaccggaacatcggccttcttgcgaatctgctccgagaacggcacctgatacccgggcttcgtcggaatcgtcacattcggcagaatgccgccggtcgagacgtccaccagatcgacgccatgctccttgagcgccttcgccaacacgatgctctggtcgagatcccagccgccctcggcccagtcggttgcggagatgcgcgcaaacaacggcatgtcgccgcggatcaccgagcgaatcgcatcggcaacctcgatcacaatgcgtatgcggttctcaagcgaaccaccgtattcgtcgtcgcggtcattgacgagcgggtcgaggaactccgacagcaggtagccatgcgcggcatgaatctcaatcacctcgaaaccggcctccatcgcgcgccatgcggcatcgcggaatctgttcacaatgtcgtggatctcatccaccgtaagctggcgcggtgcaggcaagtcgccaaatggcaactcgctcggcgcaaccgtctgccaaccacccaactcgggcgacacataaccggagtcggtgcgaatggcgaaacaactcgtcgagcccttgcgtccggcatgattgagctgaatcgccggcacagcaccagcgtccttcattccctgcgcaatccaccggtatgaatcgatctgcgaatcctcccataggcccagatcacacggcgagatgcggccgtcgggagtcaccgcggtcgcctcgacaatgatcaggccaaagccgcccatggctcgcgagacatagtgctggtagtggaagttgcctgggcgcccgtcgagagcgaacgcggaatatgtgtccatcggcggcatccagatgcggttgcgcgcggtgatgccacgcagtgtgaacggcgtgaacagagtcggctgctgcgccttgaccttcttggaatccttagacttgcccatacgcgcagagtatcacattcccattgcagcaagcggcacagttcacggaagcatccgcagaacggaccgcaaactgcgcactccatggcatagtttgcggaatcatccgaaaaacagaccacagattgcaccctccacagtccaatttacggaagcttccgtaaaacagaccacaaatcgcacccaccatggcacagcttacggaagcatccgaaaaacagaccgccagcatccgaatagcacgatgggcccgagttgccccgagcccatcgtgctattcacgccgagcgaatcaccgccgttgcgtgttctgctgtgtgccttgcctattgctttgcacgccaacgctattcgtgtacttgtcgacgggttgtccgtaatcgttgtccatcggcagctgcttcttgtcggcgtattggttcatcgcatccttgaacgcaggtgcggcgatggtggaaccatcccagtagccgtggtagttgccgttgatggcaatgttctcaatcgggtggttcgtcgggtcctgcacgtcgccgacgagcacgaaggtggcgatctggttcggaatgaagccgccggtggtcacgtacatgttctcgttcgtaccggtcttcgcgaaggtcttgcgcccgttcgcgagctgggccgcacctgccgcgccgtcgggccgtgtcacgccctggttcatcgtataggccagcgtctgaatgatgtctttgtccaccgcctggtggcagttggccttcggcacgtcgaggtccttgccgtcggagttcgtgaccttcttgagcgcgatcggcgtgcactccacgccgttggccgcatacgtcgcgtacacgttggccatcgtgagcggcgataccgacgtggtgccgccgatgagcagcgccgggtgcatcgagatgtcggaatagacgtcctcctgtccgatcttcgcattgtggtagcccacggccttggcggcgtccgccaccgcgcacagaccgatctgcgcacccatcgcggccatcgtcgtgttatgcgagtgcaccaggccgaggaacgggctttccggcgacaccgtgccattggtcaacgcgttcgtcacgtgccagttgtcggtgccgcccgtgtagccgttgcaggtgaagcggttcgtgaggaagtcggtcggtgcgacgagcatctcgttgaccgagcgtccctgctgcatccaggcgacgaggttgatcggcttccacgaggagccgatcgggaagccctggccgccgccgtcgatctgatcgaccgcgtagttcatcgacgacttcgtctggtcggtggccgcggcatcggtcgcgtcgtaggcgcggttgagcccgaagccgagcacttcgccggtgccgggcttgaccgaggccatcacgatctccatgccgctggaatcgttcgcgggaatcgtcttgttcgccacgtccatcaacgcattgctcgcgtcgaggtcgagcgtggtgacaatctgcagaccaccctcctgcagcagccgctcacggtccttcgcggtcttgccgaactccggcgagttctcgatcctgtgcaccacgtaatcgcagaagaagcccgtgttgtacttcgccgccatgcaaccgcgcgacactggcgtgatatgcagcgtgtccaccagcggggtcttcacggcctcctcgtactcggcctgcgtgatgaaatgctggttcttcatcagctcgagcacgatgttgcgctgcttctgcgcctcctcccggttctccggaatcgacggatcgtacttcgacgggttctttgtgatcatcgcgatcgtcgccgcctgcacgatgttgagcttgtcggcggtcgtattgaaataccgctccgccgcggcctgcacgccatacagcgaattcgtgccgaactgcgcgatgttcaggtagccctgcagaatctcctgtttcgaatacttcttctccatctgcaccgagatcagcatctcgcgcatcttgcgcgcgatcgtgtcctcggtcgcatggtattcggcgatcggatcgtccttctcgcgcgcctgcgtggcgagcacgttcttcacatactgctgcgtgagcgaggagccgccctgctgatcgcccttcttcatatatgtctgcacgaacgcacgcagcacgccctgcacatcgacgcccgcatgctcccagaagcggcggtcctcacgcgccaccacggcctgcatcatcggcttggagatgtccttcaaaggcacgacctcacgattctgcgcatagaactccgcgatcacggtcttgccgtcgctcgcgtacatcgtcgacttctgcggcagattcgtcacgtcgaaatcgatgccctcaacctgcatcgacggcgtcacggccttcacaacctgattcgcccccatcacggtgggcaggaagagcacggccaacgtcacgccgccgccaaggcacagcgtgatgaaggcaagtgcgagcgcaagtatacgagcgccagtgaggttcttcttcttcggcatgtctctattctatgggtctggctctaccggagcgcgaattttacagtatgttcgaaaaatatacaaacgaatgccagcctgctttcagacgacactcagattggcatatcgactgcccgaaaccgcatgcctaccgctgggaacggcggatgagagctcccggctggtagatgattatagtgcggccgttgcgtgcaatccagccccggttcgcaaaatccatgagcgccttgttcacggtctcgcgcgaggaaccgacgagctgcgccatctcctcctgggtgaggtcatgcggcacctgcagcccttcctccaccggcttgccgaagcgcgaggcgaggctcagcagtgttttcgccaaacggccgggcacatcgctgaacaccaagtcggcaatgcgctcgttattggcgcgcatgcgattcgcgagcacctgcagcatgtcgacggccacgcccgggtatttgctgagccacgcgaacaatgcgtcatggtcgagccacaccacctgggtgccgtccaccatcgccaccgcgttcgccgtgcgcgggccgccttgcgggtcaaacacgggaatctcgccgagcagttcgccgcgggtatgtatcgagagcagctgcacgcgcttgtccacagactgccgtgtcagcttcacgcgcccctcctggatcacatacatgcgctggtcggtgtcaccctcggtgaagatgtactcgcccttgtcgtactcctcatggtgcaggtaaggcacgagctcgcgcgcctgctcctcggagacctgcttgaacaacgcggtctccagcagcggattgcgtcgctcgcgtgcgtcgcccatgccggccggttcgtcagacatcgcaccgcttggcatccgctcggcggactgattcatgccgttcctccaaaggtatctatcgaaaagcactgccgttcatattgtattccccacgacaccgaaacgggaggccgtctcgagcatgcaatcgacaatctgcgcgcgcgtgcacgacgtctgcgagttcatcgggtcgacgcgtttgctcgccgatttcactgccttgtccgacatcttctccttcgacgggcgcagcacatgctgcaaatgctcggtgttcatcgcatatgccagcgtgtcgtggtgcagcaggcaaccgggcccctccccgcttgccgggaaccgacgttccgccgcgccgcctatcttgcccgccgcgctcgcaatgtcgttgaggccggcgaaatgcgcgcgcacaccgcatgcggcgagcgcctccagcagccacatatcgcagaactggtagcattgccgcgcgtcgagccccgccaccaccggctcgggcacgtagagcgaataggtgatcgtgttctgcggttctatgaacatcgcgccgccgccggtgtcacgccgcaccacttcaatgccgtgctctttggcgtattccaagtccacctcgtcggcgatcgactggaatttcccgcagaccaccgcgggcgccgcccaatcccagattctcagcgtcgcctgccgctccccgttcgcgacctgcgtggcccatagttcgtccacctgcatctgctcggcgggcatgcgtggaatgtcgacgacggtctgcggattcatccgcgcccatcgccgtttcgcgtcctgcagcccgatgagcatgggcgcaggttcgtccccagattgcgcccgctcaccctgccgtgttgcgcgcgcctcgcgaatacgctcgaattcgcgttcggctgtctgcgcggattcgcgcgcaccgccgcccaccagcgcacgcacgacggccaatgcgatcgcctcgccgttggcgccgatcagcgtgtcgccgatcacgccgcgcaattcgccggacagcgccctgtagaacgcgaggtaatccgcgctcccccagtgctcccaatcatcgggcagttccggcagatgcgcgtcgattgcggattgcgcacgccccaacaccgaaccagcgttggcctccatgaagaaatcgccgtcgattgtcgcatgccaaccgcgcacctcgtcgccctgcaaggtcacccgcacgagtttgccgccaggaatcttcacttcgccggatctcattcgatctcacccgccttggtattcgcaaatatacgcaatgcggggcgcagtccagtggaaccaccccccgcagaatgcaatgcgtcgaagtcgccgctaatcctgaagctcgacaccgcgcgcatcacggtggtgctcggtgccgtagtccgcggtgagaatctgaatcgcctccacaatcgcccagatcatcacggcaatggccccaatgccgaaggtcagcaccgagatgagcacctgtgccacgcctttgccggtgtagcccaggtagaagttatgcaggccgaagatgccgaagaacagcgcgagcgccgccgccacatacttgttgcgcggaaggtaggtcgggtacgcggccggtggctgggcgtaggtgtagttctgctgcgcgtaggcattcgggtcctggtactgcccgttgtagccgccctgcgactgcgtgtactgcggcgcggcgtaattctgcgcgggctgcgtgtactggggtgcctgtgcggcacctgacacgccgttgttctgctggtcgccgccctgtggctggtaaccgttcggatcactcatattgtctccttatacgaatgtcactgtgtatcaccgtgtgtttggtacagctcagcatacacgttcctcgcatgtgaagatatctccacagcacaatgcggcatcagcgggctctcattggtcaatacgccaccgcccgcgcaaaaagacccacgagcagccatcctcgttggccaatttggccgcgtgcgcgagaaatggccaatgagcgcaccttcccggcggcctgatttgcgcgccctgccgatttcggcacgctcacctgcccgggtatgcgaaaaggccgacccgaaggcagacctttccgtgagatttgtgttgcgtatagccccgcaaccggtttcaggccgaaatggccgaattcgaccagctcagtcgacgtagaccgggccgtactccgacggaatgtgcgtcgtggcgatgtacgggcccgaggtcgggcgcgcgtaggtctggaaaccgttgctgtagttgaatggagcttcttcgttgcagttgcagcacataatgtcctcttttcctgccgcgcgttcacgcggcgcttcctatggccgaatcgatcggcttgacgttgccatagtctacaggcgagccaagatgtcgcggcccacttcgtcggtggagcgttgccggctgccgttttcggcgatgtcgagttccacggcggcgtcgattttcgcggcggcgtcgtcgaatccgagatgacgcagcagcatggcggcggagaggatcgcggcggtcgggttcgcgatgccctggcctgcgatgtcgggggcagaaccgtggatcggctcgaacatggacgggtattcgttgctcgcgttgatgcagccggacgccgaataacccacgccgcccacgaccgcgcccgcctcgtcagtgagaatgtcgccgaacagattgtcggtgagaatcacgtcgaagcgcgacggatcggtgaccaggtagatcgtggccgcgtcgatgtgcgaatagtcatgctggacctcggggtattcggcggccaccttgttcacgatgttctgccacatgtcgccggcgttgacgagcacgttcttcttgtgcacgagcgtgacgtgcttgcggcgcttcatcgccagctcgaaggcgtagcgcaccacgcgttcgacgccgtacgccgtgttgatggagacctcggtggccacctcgtgctcggtgccgcggcggatcgcaccgccggcaccgcagtagaggccttcggtgccctcgcgcaccaccacaaaatcgatctcgcccgggttcgccagcggcgactcgacccccgggtacagcttcgacgggcgcagattcacatactggtcgagcgcgaacctcagcttgagcagcaagccgcgttcgagaattcccgccttgatgcgcgggtcgcccaccgcaccgagcagaatcgcgtcggtgctcttgatgcgttcgagatcttcgtccggcagaatctcgccgtcacgcagataccgctccgcccccaggtcgaacggttcgtactcgaaggtcgccactccctcggtggctttttcgagcgcctgctgtgcccacggggtcacttccttgccaatgccgtcgccgggaatgacggcgatcgtgtactgctttgcgttttgagtcatatgggcagactacccgctcgcactcgccgctttcgcgcggttttcagttcttggacgtttcggcgcgaacgtttcgcatagtgagattgacggtgagattagtggtgagattattcctgggattactccggagcagtcggcgccgacgcgaaccggcaccgctcttctcactcttcgatgcccatggcggcaagcacccacgcgttctcgtagcagatctgcttccactgcgcgtagcgcccgctggtgccgccgtgaccggcctcggcctcgatcttgatgatcgcgtccagacccgcggcctgcagccgcgccacccatttgagcggctccaccaccatcacacgcgagtcgttcatcgacgtggtcacgaagatcttcgggaacgccgtcaccggcgtgccgtccggccaccgcgcgccgccctcgcccggcgccggcgcgttctcgtatggcgtgtacgtcttcatgtagcggtaggtctccgcatcgtgcaacgggtcgccccactcatcccactcggtcaccgtgagcggcaacgtcgggtcgagaatcgtcgtcagtgcatccacaaacggcacatccgcctcgatgccggcgaatcgttccggcgccatgttcgccacggcacccatcagcaggccgcccgcggagccgccgttcgccaccgtgcgcgcacggtcggcgagcccgcagtcctgtatggccgcagtgacgtctatgaaatcttcaaacgtgtgcttcttgttgcgtctgcgccccatctcgtaccatgcgcggcccatttcgccgccgccgcgcacatgcggcaccacgtagagcacgccgcggtcgagcatgctcagtcgcgacaccgagaacgccgggtccgaactgatttcgtaggcgccgtagccgatcacgaacatcggcatgcgcccgcgcacgcaatcgcgtcgccagacgagcgagacgggcacctgctcgccgtcgcgcacctgcacccagatgcgtcgctccacatagtcgcgcgcgtcgaaactccccagcacgttcgcgcgtttgagcagcacgtcctcaccggtgcgcgggtcgaactcgcgcagttcgcccggccgcgtgtagcccgtcaccatgtagcgcatgcgcggcgcctcgtagctcgggttgccggcggtgccgatcgaatacaggcgcgccgaggagccttcgaaatccttgagttgcggcggattcaccgcagcgtcgtccgaggcgccgtcccaatccccatcgagctcaggcacgttcacctcggcgaattgccaggggcggcgcgcgaggaagtcctgtgcggcctgctgtttcgacatcaccgcgagcttgggcagtccgttcgcgcggtacgagagcgccacgaaatgctcgtgcatcgcgatgccctccaccgcgagcccgcgcacgccgcgcagaatctgcggattcgtggcatcgtcgtacggcgtgcccaccggcattgcggacgcgccggcgatcaccttctcgccgtcctcgctgccgtacggcgaaccctgcacaatgcgcacgccatcgccaatgcggtagggcgggcgggcggcgctcatgtcgatgacatcgatctcgaaattcgggttggcgagattgtggtagacgattgcaaccggcagatcctcgccatgctcgcccgcatgttcgaacacggcgaagctcacgtcgtactcgacgccctcctgccgcggaatgaacgcctggaactccccctccggcgtcgcagtgggcagcatgagcacctcggtggtcgttttcgaaccggtgccgatcaccagattccgctcatcgaaggagagccctatgcccacccagaatttctcgtcgtgttcctcgtacacaatcacgtcgcgttcgaccggctcgcccaccttgtgccggcgaatcgcatatgggcgctgcgcgtcgtcgagcagcgtggcgaacacatagcggccatcgggcgtgaagcacgccgcagccagcccgtcgagctcgtcgggcaactgttcgccggtgtcgaggttgcgaatgcggaagtcatactgttcgtcgccggacgtgtcgacgccgaacagcagccatgtgccgtccttcgagatgtccatgccgccgatctggaagaaatcgtggccctcggcctctgtgttggcgtcgaggatcacctgttcgccggggatcacgcccggcgcatcgttggcattaatctcgggcggcgtccaatcgtcctcgccgcggatcggcatgcggcactgcacgccgtactgcttgccctcctgcgtgcgtgcgtagtaccagtagccgtccagtcgcgtgggcaccgacatgtcggtctcctgcacatgcgagcggaactcgtcgaatagcgtcttgcgcagattggccaagccggccgtgcgcgcggaggtgtaggcgttctcggcggccacatacgatttgaggtctgcggaatctttatctcgcatccactcgtaggggtcggtgaaggtgtcgccgtggaacgtgcgcacggagggaacctgcttcgcctccggcggcttcgggaaaacatgcataccagtcattaggccaaagattatacctgcgcaccctcccttgcgtaaaaagggacatccgcagacttccacctgtcccttttacgccccactttctgcgtaaaaagagacatttacgcgccctatctgtctctttttacgcagatttcttctgttcaatgcggatttcttccgttcagttgtttcactgcgtaaaaagggtcggctgccgcagaggaggctcggactcacatgaactgccgcaggtacggcaacatcgtcttcatgatgttcgaaccggtggtgcccgtgaacaccggcacgtcggtcaccggcacaggctgcgtggtggagaagcccgacattgtgccgaatccgccggattccttgggcgagagctggcgtatgcctatggcgagcacacgccccgggtagcggcgagcgatctcggcgtaggtggtcgggtctttctgcccgtcgtcgccgatcagaatgaacttcatgtcggggaagtcctccatgagctgctcggcgtattcgagcttgtgctgcacgccggagggtacgaaggtcttcggccgtgggtcgaggtcgcgcaacagcagcggaccgtcggggaatccataatccttcagaaagttacgaatcgaattctccacattccacggcgaggtggacagatagaagaacggcgcccccgggaacatgctcgcgatcttgttgtacatgaccgccatgcctggcaccgacgcgcgcttgtgcgggctcaggaacagcatgttgtacacggctttccacaatgtgggcacctgcgtgaccatacaggtgtcgtcgacgtcggagatcacgcccaccttcgccgtgctcggtatcgtgaacagctccgcctctaccgccggacgacgcgtcaccttgcagctgaccatgtgcacgcccggctcgagcctgtgctcggcgagcaagtcgaggtagcctgccgaatccgaaaccgagtaatccatcgtcaccgaccgtgcggaatcgaccgggttgtagacctccatcgtgcccacctgcacggttcgcagcggcacaccgtcgatgtcgatctgcacgcattggccgggcgcgggcacttcgagcatcgcgtggatgccgcgcatcggcttgttcggctgtccgtctgccggcgcgaggatagtacggcaaaccagtcgcgagtattcctccgtgccgtagcccacgtatggcttgaccatggggaaccaatgcagctgctttgcgatggccgtggagaaccgtatccacaggccgaacgtccaagtgatcgccttgcgcagcactcgcttgatcgatgagacgagtttcggattcctcctcagccgcgttctccccgccggcgctttcgccgcggagagcgagccgagcggcacggccacggtcggcatgtcgtctgtggacgtggctgcggacgtcgtgcgcaacgccaccgccggcgcccgccattgccgttccggggtctcggtttccgcctgcccgttcgcaatgccggtgatgacgcgcgtctcggcggagcctgcatgctgcgtgtcgtcgaagtcggcgtccgtaggcccttcgccggatctcaccgtgcgaccttgcgtcgcaaccgtgctaccgtcgccgtccgcggcgaggcgtgcgcgctcggcctgttcgcgtttcacctgtgcgagtgccgcctcaagcagacgcttggtcttcctgagctcgcggtccgacctgtccgtatatgccatgtctctaacgcattttccgttgattgtttcgtatatatgcctgcgatacccgtattctactgctgctgggcaatgaatttcgcgtattcgccggccgacagcagatccggttcgtcgtcatcgagctcgattttgacgatccacccctcgccgtacgggtcgtcgttgatgaccgcaccgtcgtcctcggtctcgctgttcacgtagcgcaccacgccggccaccggcgagatcatcggctcgacggccttcgcggattcaatctgcacgagctcgtcgcccgcctccacgcgcatgcccacctcgggcaggtcgacgaacacgatgtcgcccatcttgttcgccgcgaattcggtgatgccgagcaccgccggcgtgaccgattcgtccacccacacgtggtcatgcgagtactgcaggaagtccggcacgtcgagatgcgtgccctgttcgttctcctctgccatattctctccttgtatcgttcgtgctgtccgattccgtattcggctgtcctgtgttccgcgcgctcagtccagttcgcgcccgtaccattcctcgatcataacgcgtgcgatcgtcgccttgccgggcgcttcgatctcgccggtgacgagcagattcgtgtattcgtcgcgcgtcacccatcgtgcggcgatcgtctcgtcgccgtccacgtggatgtcgttgctcagcgcctgcgccttgaaccccatcatcagcgagaacgggaacggccagggctgcgagccgaggtatttcacctcgcccacgcgtatgccggtctcctccatcgtttcgcgcctgcatgcgtgttcgaggttctcgccggtctccacgaaccctgccgacacggagaacagattgctgtgtttccacgcgcggttgtgctgcaacagcaggcggtccttcgcatcgaccacggtgcagatcaccgccggttcgactcgggggaacagtatgcggtggtcgtccgactcgcttgtgcagcgttgcgcccaacccgacatcgccggttcggtgggtgcgccgcagtgtgggcaatgccgttgcatgtcgtgccagttggcgagcgagagcatcgtgaccgcctgccctatctcacgtgagctggcgtgcggcgcgaacatgcgcaggtcgacccagtcgaaccgttccaccgcctgctcgaacatgttcacggcgttgctgtctgcagattcgcgcgcatccacgtcgtcgccgaaggccgcgtcgacggcgtgcccggccgctgccgcgcgctcctccacgcgacgcagctcctcgccctcctccacagccgtcaggtccaacgcaatggcatgctcatcgtgcgcgcctttgtagcggcccagatacatggccaccacaccgttgttgccgtgttcgagcgcccgtgccacatacgagccgggcaaggttgccaaacgcatgcgggaggcggccaattgcgccatgttgtgctgcccgaatggcacggccaccttgcccttgcggcacagcagcacacaggtggagggcatttggagcacctgctcgatgagctgcgggtccgctcgccgttccacctggtagtcgatgtcgccttgggccaagggcaggtagggcaatgcctgcgtcaatgcgagtggtgcgaacatcaggcctccctggctgcaatggccgcgtcggcggcagcagggtcggctccggcggcggccggcaccctcgaaacgagttcatgcaatgcgcgggccaccgtctcagggcgttcccatgcgctgaagtgcccgcaatcctctatttcggtcatcaccaccgtcgtgttcaccatgcgttcggcgaggggtctcatcacggcgggagcgctcgacgggtcctcctcgccgcagatcaccgcagccggcgccgtgatcttcgcgaattcgtcgttcaggtcggggcgtgcggccgccatgcgttcacgccaggcgacaccgtcaggctgctgctcgcgaatccattgcgagaactggtcaatgtacgcggcggatttcttcacgctcgaatcgccttcatgcacgtccacgaagaacatcaccggttcggtggtctgccgttccacgcattccttcgcaatggcgatgcgcgaggcatgcgcctgatcactgtccgcgtcgcccttcgtgtcgagcaacgcgatgccggccaccgcctgagggtgacggcgttgaatgccgagcaccacatagccgcccatcgacaggccggcccagatcgcctgcgtgtacccggcgtcgttgagcagggccacgtaggcgtcagcgatgcgatccaagccgtccggcaacgagccgtcctcgttctcacgcccgctctgtgccgcagtcggcaccggactctcgcccgcacccggcatatccggcgcccagatcgggtactgcacgagctcatcggcatcgctcagctccatgagcgccatcgcacaacgcccccacatgcggctgtccaccgggaagccatgcaccagcaccaacggaatgccgttgccctcacgaatcacatggtttgcaatcaccggcaattcccttgcatggtcgtccgccatacccatctccctcactcggtttcatttcatactgtcaaacgactgttaagcgtaaacacccagaaatccaccagtctgctcacagattcacccacgcgagcgcctggcgcacaatcgtgccatgcccatcgttcatctgctcaatgaactcggtaatctgcgggccatgcggatccacccactccacgtcgagcgtctcatcctgcggcttgcagtcaccggcgatcggcaccacatagcacagcgcaatcgcatgctggcgcgcgtcgaagtacggcgagactcccggggtcgggaagaactcggccaccgtgaacggtgtcaacgtctgcggcagcaccggcaatgcgagctcgcccatgtccttcgaaatgttgcgggcaatcgcctcacgcaacgactcgtgatacagcacgcggccagcgatcagcgtgcgctccacaatcgactggtcgttcgccacgcgcagcagggagccaatctgcgtgacgcggccgaaatcatcgacgcgcacgggcacgatctccacatacgcaatgggcatgcgcgaacgcagatcggcaatgtcgtcggcaccgagccagccgggagggttgcccgtgccacgcgtgatgtcttcgggcgtgatgtggtcgaactcgccgcgggagcgtccggcgtcgaaatcgccgtcatcgggcacttcatcattcaagactcgcatacccctattatgacgcgcgcaagcaacgaacgcacgccggcaggcagaatccggcacgccgacatatttacctcgtggcgtattgcaggaaactcacggaatgaattgctaaacatggggttgtacgtgaataagggacgccaagaaacgccccgacagactttaaggagctagatatggcagttaaggaactcacttccgcagatttcgaacaggcagtgaagggcaacgagatcgcgctgttcgatttcttcgcaacctggtgcggcccgtgcaaggcgttcagcccgatcttcgacaaggtggcggacgagaaccccgacatcttcttcggcaagatcgacatcgacaagaaccaggaactcgccaacgcagccaacgtgcaggccgtccccacgctcatgatcgtgaagaagggccatgtgatctaccaggaggccggcgcactgcgcgaagccgacctgaacgatctcatcggccaggccaaggcgctcgacgtcgaggctgcgctcgcagcggccaaggccgcaggcaccgaccaggacgagctgatcgaagagcatgacgcctgattcggcagtcattccgccaaggcgacacatgcacgacatgtgccgccttttcatttgcgcaatgttcaatccgcatgccagcgcatcgcagcaatctcgcagaagtattgtgtttctctatcggccgaatgtgagaactgggtgacatattgccctctgcgtggaaaaactgcaacggtgcgcgtatacttctgcccagcatgtgtttgagacgcccggtttggcagccgcacacagaagacgctcgttaacgaagtcggcgtcttggcatcggcattatccgcagactttaggagaagaatggcacaccatagcaagcacaacgcacctacgctgcgctcgttgagcaaacggcagtggattcgcatttccactgcgatggcgtcggtgggtcttgtagtggccggagtagtcgcaacccaaagcatgtattcgcgtgccgaggcgcagccaacgcccagcgcaaccgcatattccatcaccgagagcaatcatgcggcctcccgtggcaacgcccgcgaggccatggacggcgacacctcgtacgtcaccgtcaaggtgaacggcaagtcccgcgtcgtgctcggccaggacttcaccgacgtgaagtctgtgctcgacgccggcgacatcacgttggagccgggcgatcaggtgaacccgtcgctcaccacgaaggtggacgaatccaccacgatctccatcgaacgccagggcgcgaagatggagaccacggaatcgaagatcccattcaacacggtgaagaaagacgacccgtcactgccgaagggcaccgagaaggtgcagaccgagggcgaggaaggcattctcgaaaagacgaatctggtcacccgcaccggcgacaaggtggtctcgtcgaacaccttcgccacctgggtgaagaaggccccggtcgagaaggtggtgctcgtgggcacagggaatccgcagcccgccgccacctcggccccggcgcagaccagcaataactcgaataccaatgcgaacaactcgtcgcagcaggcggcagcctcgagcatcggctccaccgcgcctgtgggcgagatgcagcagtgggcgcatgactacctgcttgccaacggcggttcggaaggcgacttcaccgccaccgtgtacatcatcagccgtgaatccggctggaacgtgaacgccacgaacccgagctccggtgcctacggcctcgctcaggcgctgccgggcagcaagatggcctcgcacggcgccgactggcagtcgaactaccagacgcagctcaaatggttctgggactactgcaagggccgttacggctccgtgcagggcgcctacaacttctggcaggcgaaccactggtactaaaccgcagaccggtttcccggcactattcagggtggttcatccaacatggatgaaccaccctttttgttgcggcaacaaaggccgccattaaatctcttatgggagacgataaacgcctccacgattcccaagatcccacttatttcccggtattatggaatgctctcctgtaacagccgattggctacaggtagcaattatggatatggctaggaaaaagatgggggctcttagtgtcacacaacacctagagccccatcaaacatacgtatccaactagtaggcgcccgtaccgcggatgaccacccacaccgtcttgatcagaatcgcgatgtcgccggtgatcgaccagttctcgatgtacgagacatcaaggtactcgctttgctcctcggtgaggtcggagcgcccggagatttgccatggaccggtgatgcccggtttcacgagcagacgggccgaatagagcgaaccatagcgcgccacctcctcgggcagtgccgggcgcgggcccaccatggacatatcgcctttgagcacattgaggaactgcgggaattcgtcgagtgacgtacgtcggatgaagcggcctacccgtgtgatgcgtggatcgtccttcatcttgaaaatgaagcgatcggtctggccggtctcctgcatcagctttttcttgacttcctcggcgttcgtcaccatggaacggaacttgtacatctggaatctgcgtccatgcaaaccgatgcgggtctgtttgaagaagatcggaccaccgtcgtccagtttgatggcgatggccacgccgagcatgattggcgacgagatgatgagcgctaacgacgacagcacaatgtcgaaaatgcgcttcaacaggaatgtcgtggcacggtattgcggcaggctagccagtagaatcggctgttcggtggtgttgtgcaggtacagcctatggcctgcgacatcggccaatgccaccgatagcgcaagctccatgcccaaggattcaatggccagtgcaatgccatgcagcagtttggaatcacggtcgagcacatcggccacgaaaacctcctgcacgccgatctgctgcagtttgcgagggaagttggagttcaacggcaccgtctgcacagcgtatttctcggcgatgccctcttccggcacaaaatcggtcataatgtaggcatcgtcacgatccggcactttctcaatggggcatatggcgacggcgcgatacccccaattcctgttggcatcgaagagtttgagcacgctattaatgcctgcggaggaaccgataatcaccgtattgtacttgtattcaccctcttcgcgcttcctatggagcatcaggcgaaggaagagcctgccgaaaagtgccaacaccatgccgaagattggtgcgacaagaagaatggtgcgagggtaatccaaatgcagcatgaacacgatgaagcagaacaccacaatggtggctatcgtggcgttgagcacctccacatagagctcatatccctctgccatgatgtgcctgtggtacgtaccgcgccacaccaaacaggtgagccacacaatgcagtacagcacaatgaacgcccagaccggcatgtaccgctcaatcgtggtgtatgcctcgcgattgaccaacagtacgcccaccacggcgatcagcatcgagatgacatcaaccaccgcaatggtaaatatgaagaggaagcgccagcgaggcgcgttgcacaggtgattggctcttttcttgccggattcctcaaacgaggtgttgtagaacgtgatcggctcatacggcaactgctggcgcgtcgattctttcgactcagcacggtgattctgctcatggcctgtgactatacgtatttcctgcgtttgcattgaggagcctgcagtccaccgagatgtatcacgcaccgtattcccttccgctcctccgccaagcaaagccttatctagtatattcagtcaataggacactatttataccgaataactcgcgaagaatgtacattgaactcgcattggcaagtgttacacatatatacttgtcgaggctcggaaatgggcatcgggatatcacggcaaacaaaaacggccaccgcgaacggcgaccgttgtaatagataggggctagattggttcaggcctcggagaccttcaccttctggcctttcttacgaccacgcttcttcatcacaccctgctcggccttcgccgcattgaacaccagcatatcctcggagttcagcagcgtgcccttgatctgtgcgtaagcctcctgatcgtcctcgacttcggggaactcgaaatacggccccattgcgtcaagcacgaactgctggttcagcgtcaccgaagcggtggtcttgcctggaatgaagaacggaatcgcattcgggttgctttcctcgcatgccttgaacgcgaactgcttggtggtcgggttgatgaagaactcaatgaattcagggcgcccaagttcaagcacggcgttcttgttcaaccgagcgtagttcttcgtgactgtgagtacggaacgaccggaggccgtgttcgggctgactacttcgaatccttgcagagacgacatatacaaacttccttacgtcgacagacggattatttcgtaacaaactgagaccgtatgtcacagcgatacatgctcaatatagcatcttcagtagagattattgcctgatttcacatatttcggtaaaaagaatgcctgatttacaggagtcttttagaattttccgagtcaaccctaatccgtgaaatccataacgccatataccacgcatgctgcacctgcacgaaggaggagacacattgaccatcaaccacgctagactcgtggcacgggtggcataattccactacattcgacgccccatgatccggggtggagtccatttgttacggcacgataaggaagaggaccgttcccagggcagatgacgaaccgtcggctgctggaaatccacgaagaaaggagactcatatggaggcaaccaacggggattccgagaaaacaatgcagtcagcacaacgccatcggcatacggacaaggtttcttcaccattccccgaactcattggcaagggactgcgcgaaagctggaagatgatggccttgttcctcatcatctccatggtcgaaggcattgcgttcatcaccacaacggcgccactgaccatggcggatcccgacatgcatcttccatcgacctatgcattggccaccggtcagtcgttcaatatcacacgggcaccagagtcccaccggcaatatgacccacgcacttcggaggttcccagcagcatgccggtcggcggcagacaattgctcacaggagaagcacgatatctccaaggcagcgtgaatggggcgaaaaacgctctggtggaatcgatcaacccattcgatctcaccagaaacgacgagtatgccacgcagtgcgacagactgaacaatcttgccgagggggaacgtatcatcacaacacccacgcgcagtaaccagtacatgttcttcgcctacattccgcaagccatcggcatgaaattcggcttcctcacccatgccaacccaagtacctgcatcaactacgcccgggcttcgaatctggtttgttatctgctgttgttcctgctcgccatcgctgtgattcccacagcaaaaggcatcatcgcactgctgggcatgctgccgttacctgtgttctgttcaagcactttgatgacagacggcacactattcgccgcagtcgccttgttcatagcggtatgcgtacgtctcatgcaacgcgaacgccgtctgaacaactggcaggttgcagcgctcactgtaggcacctgcctgatatgcttcctcaaatacgtgtacataccaatcattctgctgccatggcttgcgtgcaaagcactgtctggaaagcagaaagtgtggtacacagcatcgaccgttctggttgtcggcgccacagtgctgtgctggcagaaattcttcggatacaacccagaacgcgtggaaggcctatatgcctataatttcaacgcggcactgcataatccctttggaaccacgttccggattctagccaatgtgttcctgaccacattcaacatggtacagagcaatcccacgttaatcgtctgcctcattcttttgctcattgcatggatgttcggccaggacgcccgcatcgccgttcctcggcgcaccaccatgcaggtttacacacttgtcggattcattgtgtttgccacactattcctcatgtacatcccgttcctgctcacctggacgcttccctccgaaagtctcagattggatggcctgcaggtacgctactattatccgattctgcctctattggtaatccccttcatctaccgctacaagaccggaaccaaggatctcgtcactgtccatcagtgacgggctcatgcgagacctcgtcaacgcatgcacggtagggctcgctgacgcttggatgacgaccagatgccgcgatgtaggtctgtgccgcgaaggcgaaacgcgaacgatccttgcgggcgaacaccgcgagcaccaaaccggtgaacaccgcaatgactccgatgatcatcagcatggtggatccaatcagcagcgggaatcttcgtaccatgccggtctgtgcgaattcaatgcacacccacagcgccaagccaagcccaacaccgccaatgatgcctcccaatgtgccgaagaacggcaacgggcggttctcataggccaagcggaaaatgaggttgagcaccttcgcaccatcggagaacgtgctcagcttgctggtgctgccctccggccgatcccggtactgaattggcacctccgtcacacgcagcttgcgatccagtgcgaaaatggtcatctccgtctcgatttcgaaaccattggacatgaccccgtacgcctttgcaaacagattgtcgaacacacgatacccgctcatcacatcgcgaatctgcgcgtggaaggtgctattgatcgcggagcggaccaagcggttgccggtattgtggaatgggcgtttattttcggtgaaataggtcgaggaaagtctgtcgccgaccaccatgtcccagccttggtcgagcgtgtccaacaaggtgtgcacgtcttcggccgggtaggtgtcgtcaccgtccaccagcacataccggtccgcatcgatgtcacgcagcattctgcgcagcacattgccctttcctcgttcaggagccatacgcacgatcgcacccgcatcagcagctacctgtgaggtgcggtcgtcactggcgttgtcgtacacgtagataacggcatccggcaattcgcgacggaagtctgccaccaccttccctatcgtctgctcctcatttaggcacggtatgagtactgcggtcgtctggtgagtggtcatcgtcgcgtctttccgttcgtcatacggtttctagtgatgcggtctccaatgtagtacctctgcagtacgtccacccatcaattgactggacacgaattgaggtactccacattcgtgttctcggtgcccattggcgtctggtcgacggcaagacgactcgccgcctgtttcgacgtcgttacatcgaaggtgtaggtcaccttctgttccggcctcacctgtgccagcgaacggtacatgatcgccgcgttgaatgaatccatggccggaaccgaaccggttccctgcaccttgaaattgctcaattcaccgccatacggcgggtagaagaacaccttatcgaggctggcaccctcattgtaggggaactggccggtgatgtaccagctgagcttgcccacctcgtcttccttgagcgtgttctccaacgtgtactccacctgatatttgtagggtgcagagtcggtgcagatctgcttgatcttcgtggaacgcttgatataccaacccatcttggatgggttctgttcggtgaggtagacgcccaatgtggggttcaccttgtcggtgggcaacgtggcggagaatccggcggccttgatgaggtcctccaacgatggcgtgaatgagtacatcgccagatggcgttctttggccaatgtgcgcagatctttggcgagtgaaccaatcgtcttcatatccatatgcttcatcaacgtgcccacgcaggccttcgccacgatgccgaagtaggcgttcgtctcctccggctcatgttcggtgtataccgtattcatcatgaattgggcggtgttattgccattgagcacagtgccatccggcagtttcacgtcaccggtgactttcacgagagcctgcaccaccaccggatcaaccataatgatgccgttgagtgtggtcttctcgccccatggcattctcttccacagcgagaggaacgcattcgccgtcatttcggtgtcggtgaagttggccagatcacgtacgtcatacgtcatatacaacggtccgtcattcatgaaaatgcgtttggtgtcgaaatccacatctgcacctccttccttgacatacgcgtcattgggaaggaattcaccaatctcaatcttgcctttgttgagagtcagcgtaccgatggccccgataaggccgccggacatacgcatctccgcaggtgtcattgccatgaccgcataagtttggggctccttgtaccccagatagctcggcagatcctgcataatggtttccgcctgcttgagcagcccatcggctgtccccacatatcccttggccatgttgaccagattacggaccacgccgatcgatggttccggaatgtcgttgatgcgtgcgagctggctcatcagatcactgttggcctcgacgaaattcacgtattgcgcggtgacgggtttgatattgacctgaccgttactgaacagcttgtccgacataatgttggacgcgatatctatgtatttgggcaccacatcttggcttacatccgcaacaatctgggtcagatcttgcgctgcaccgatgttgctgcccatgcccggccatgatccaatgaaattccataggccgttgtgcgtgatgcggttggcttttctggtgttttcctgcatcttcgagacggcgttcggcagttccttcacattgccgctcatcgcggtgcgcctgatggtgtcgatggagccgagctcgtaattcttcaccatcattgcctgcacgccaaaagtgccaaaaaatgcaacgagcactgcaaagatgccgatgagtgtccagccccaccatcggatacgcttgtaccacgggcgctttggagcggcgacctcccgctcctgtgaggctgccggttcggattgcggtgcggttcctgcagactccgcagactgatcgatgctcttctcaatctcgggttcattgccttctgttcgggacatgcccaccctttcgtaccggatcgggatccaaatcaatgtctttcaagaataggggtgctgcagtacaagaagcgcgaaaggttcgctcggaacactttccggaacgaacctttcgcacatacatcccctgcgctgtcgatgcatcaatcgtcgatggtgctgaggaaccggtgttcggcaacgtcgagcaggtgcttgccgtacgggctcttgccataccgttcggcggcggcaagcagctggtcacggtcgatccagcggttctcgtaggcaatctcctcgatcaccgaaatcggcagaccctgtgcatgctccaccgtgcgcacgaactcgccggcttcgaacaacgagtccatggtgccggtgtcgagccatgcatagcctcggccgagcgtctgcacgtgcaatgaaccatcgtcaaggtacatgcggttcaggtctgtgatctccagttcgcctcgaggtgatggtttgacctgcttggcgaagtcgaccacgcggttgtcatagaaatacagtccggtcaccgcatagttcgatgcagggtgctcgggtttctccacaatgctcactgccttgtgctccttgtcgaactcaacgacaccgtagcgttccgggtcatcgacgtagtagccgaacaccgtggcgccatgttcgagcgcggctgccttgcgcagttggcggcccaaaccgttgccgtagaagatgttgtcgccgagcacgagggcgcatgcatcgtcaccgatgaagtcctcaccgagcaggaaggcctgagccagaccgtccgggcttggctgaaccttgtactgcaacgagatgccgtatcgggagccatcgccaagcaggcgctcgaaattcggtagatccttcggcgtcgagataatcaggatgtctcggattcccgccatcatcagcgcactcaatgggtagaagatcatcggcttgtcgtacaccggcaacaactgcttggaggtgaccgtcgtcagcgggtacaggcgagtgccggaaccgccggcaagaataatgcctttcatctggaacccatcctcacttcttcagttcgacttcgacataggccttgagactgtcatgccaatcggtggtctcatagccggtctcctcgatcttggccaaatcgagcgtgctattcgtcggccgtgggctcaccggagccttcgcgctctcgaagtactgctcggtggagatcggacgcaccttgtctccattgccattcgtcatggcgaacacctcggcggcaatctgtgcccagctcaccacgtcaccggaaccagtgagatcatacgtgccatacggatcctcatcatcgagcagatggaatatggcagctgccatgtcatcggtgaacgtcagacggccatattggtcatccaccaccgtcacctcattcaatgcatcattcggatcagacaccttgttcgagagcatcatcatcgtcttgacgaaattatgcccattgccgatgacccaactcgagcgcacgatgtagtgcttcggggcgttggcgacggcgatgtcgccggcagctttcgtctggccatatacgccaagcggcgagaatgcctcatcttcgtcgtgcaccttggcggtaccatcgaacacatagtcggagcttacatgcacgagggtcagattgtgctcggtggccactttcgccagcagcgccgggccaagtgcgttggccttccacgccgtcacacgcccttcgggcgtctcggccttgtccaccgccgtgaatgccccagcattgatgatcgtgccgtacaggctccagtcatacccctcataggcggcaggatccgaaaaatcgaattcgtcgatgtcggtgaattcgaatcctttgagatcatgctcttcaacatacttgcgaatcgactgcccaagctggccgttcgcaccggtgaccaatgtgcgcttcggatccattggcttggcatccttgagcatcgggtgatgcaggtccgcttcggagagttcggcctgctcaagcggaatcggccattggatgttgagttccgggtcggccaggttcacgaaggtgtatgtcttcttctgttcgagagaccaatgcgcgttcaccaaatacgtgtaggccgtgccatcctccaacgcctggaagctgttgcccaccccgcgcggcacatatatcgccttcgacgggtcaaggcgcgtcgtatacacctgcccgaaggtgtcacccggacgcagatccacccaggcaccgaagatctcgccggtggccagcgagatgaacttgtcccatggctcggcgtggatgccacgggtcacaccgcgtttcgcattgaaactgacattgttctgtaccggctggaagtccttcggcaagccgagtgccgtcatcttcgccttctgccagttctctttgaaccagccgcggttatcgccgtgcaccggcaaatcgaagaccaacaggccgggaatattcgtctccgtgaccttgagttccttttcaaattccatagttcacgctttccacatcactgttgcatgtctgtacatgatgaatccgccgagttgcggcggattcaaagcattcactggccctgggccttgtacttggcctcggtggcggctttcgccggctcccaccactgcgggttgtcgatgtaccattgcacggtctgacgcaggccggactcgaagtcggtgtgcgtcggacgccaacccagctcggtctgcagcttcgtcgaatcgatggcatacctgcggtcgtggcccgggcggtccttcacccagtcgaaggcgtcctccggctgacccatcacgcgcagaatgtcgtgcagcacggtcaggttgttgcgttcaccgttggcgccgatcaggtaggtctcacccaaacggccagtggtcagaatcgtccacaccgcgctcgaatgatcttcggtgtgaatccagtcacgtacattgagaccatcgccatagagcttcgggcgaatgccttcgatgatattcgtgatctggcgcggaatgaacttctccacatgctggtacgggccatagttgttcgagcagttcgagatcgtggtgcgcaacccataggtgcggtgccaggcgcgcacgagcatgtcggagctcgccttcgtcgatgaatacgggcttgacggatggtacggcgtttcctcggtgaacttcgctggatcatccagagccaggtcgccatacacctcgtcggtgctgatgtgatggaaccgcacatcatacttgcgcgccgcttcaagcaggcggaatgtgccctcgacgttcgttttcacaaacggttccggatttgcaatcgagttgtcgttatgcgactcggccgcataatgcacgatggcatcatgccccggcaccagttcgtcaagcagctgcgcatcgcagatgttgccatgtacgaactcgacacgatcgccgaggatcggcttgatgttctcgaggttgcctgcatacgtaagtgcatcgagcaccgtgatatgcacatccgggtgattgttgtacacgtaatgcacgaaattcgagccgatgaaaccgcagccaccggttacaatgatgttcttcggaatgaatgcgtcagtcataggcatcagtttagcaactaccaactatcagaacacccagcttcactgtggtatcgatcggattcagcagcatattgggcacatgtctaatccatgctttctccttataggagtatcttgaaaaccgaaacatctcatgaggaaagtagtcatccatgcaacctgaaattgaaattctcatggctacctataacggcgcggaatatattgagcaacagattgaatccattcagcagcagtctgtgcccaattggaaacttagcatctccgacgactgctcctccgatggaacgcttggcattcttcagcgaatggcgaatcacgatacccgaatcaacatcgtttcacagggagtgaagtatggttctccacaagccaatttcacttttctcatgagtcaggcatcaggtcaatacgtgtttctggcggaccaagatgacatctggcatacaaacaagctggaactattcatgcaacgcatgcataacgctgaggcacggtatgggaagaatgcacctatcctcgccttttccgatcttgtggtggtagatgcaaacaatcatgttattgcaccatcattcctgcgattcatcgggcgcaaccctcatcggacacagctcaatgagcttcttgcacagaatctcgtcacaggttgtgcaagcgcaatgaatacagctctactgaacgtcattcaatcttgggatcccgaaaacgccaatcgtatgatcatgcatgattggtgctacgccctcatcgcagccacgttggggcatgtggtatatgtggacgaagcaaccgtgaactataggcaacatggggacaatgcgatgggagcgcacagttactcggcattgaaaacgttcatgagtctcgtaatccatcgcaattcgattcgcaggcaacgcgtcacgcatatgaaccacatgttggatcaggcgacctatatacgtgatgccttgtctgatcttcagcagactcggaatctcataatccttgaccagtactgcgctttgcctcagatgacaaaacgtcaacgcacacacacactgttcgcatacgaattctggccgaacaagttcatggatagaatcgtccaactagcgaccatacgtgcgttgtagtctagcgtttcctcaccattgacatgatgaacgattccttgacaagtacaagcaagccgccatcagcgacgcaaaacaccagcgctgcgatgatgatctgcacaaatgggttccacccacgcatcgcataacatatgccagcggtcactatggatgccaccgcccacgcaaaagcaatcttccaataatcggtatatttacggactttccgcatgaagtcacgaagaatataggtgcgaatgcaatagacggacagctccgtaagcacaagtccaagtgcagcaccattaatgccccacaaaggaatgaagatgcattccagaacaatggcaatcacaagaccagccacattggtatacgtatagaccttttcctgatcggaagcgaccatgtattgcgattgcatggaaccaattgacccaagcagcacaagtggtgcgccgattttcaatgcagcattgccgggaagatagtcattgcccccaagaatcatgatcagcggatcggcgcaaatgaccaaggcggaaattatggccaatcccaacatcaagaggaaattgaaattcttcgccatcaacttggtcgtctgatcatgcccctcctgcgcctcgtagtatgagagtctcggcagcatgacgccagtgaccgatcctccgacaccagtgcacatgttacgaatcttgaataccagctgatacaaacccagcgcatagttcgagctgaaaaaaccaagcaacaacatgtctatctggccatacatgcccgacgtgatgctggaaatgctgaacgcgaacatgggtttgaaatgacgccggatgttcatctcatattttcgtgaaaaagtgacgaatgaacgtagccgaagaatattcagaacattcgagcccgttgtaccaagtacggtaactgcagcataggccagataatcgttggtttgacgtacgaaaacaaacagcagcacaatgctcgctattttgaagagaatatttcgtactgtgatgtactcgtattgttcgatggatcgatagaaccattccgcgccgcatgcggaaagccatatcgaggtgcccacaatgaacatgaggggaagttcgtcatgggtgcggggcagcaaaaacaccagtacaacgaatgcgacgtacacaacagttgtggaacatatcagaatgacaagcagctcctgaaccaccacgctcagtttctcgcgatcgtctcgaagctttgcacactctcgggtgccatacatattgaaacccagcaaagccacaagagagaaataccctacgaaagtaaacgcccaggaaacgatgccgttgttgtcgggccccagcacgcgggatacatacggcaccgtgatcagagggaataggaaggtggaagtggtcaggattgtattcatgaccacgttgaatttcactgagcgtatctttggctgtttcagctgcctgcccatgtatatcctcaattatctacttggattattttgagttgacgtactgtttcagtaccttcaatgaacgcacatagttatgcagcgtgaagatcatcttcctacgctcatctttcctcatcatctggtcggtggagacatcctccatatgatctacccggatgcgcttgtcgtaccacatcgtcaggtgccgggctcggcatcgcatcaacagaatgtcttcctcaaaatagaggaaagttccggagtcgaatgcgcagctgaactgcttgacgaatgccggtgtaaatacaaagcacgcaccatggagcttgtaaggtttgccggtaatggcatctgccgtggcattgacatgctcgggcaatgcattggcatcggaatgcgtgagttttgccttgagtcgggtcagcgggccgaacaggtgaaggtgcagcagaagcagaatcaccttgaagcgccatatctgacgatccacctccgcgcgggtgtcgatgatcgaataaatcgggttcgagtgcgaaccgttcttgcccgaaacgatgtccggaccaatcacccccacatcaggatgcgccttgaaatcctcctcgcacagctccatgaaatcatcgcaggaaatggtggcatcgttgttcatcgtgacgatgaaatcgcaatgcaggcgattccgcgcatattcatacccggtattattgccgcgggcgaacccttcattcactgcgttatgcagcaatgtcacggtggaatcagcaccatacttgcgttgcagctcctcgtagctaccattggccgagttattgtccaccaccacgatgacagcttgagggcaatgcgttttgatggattcgatgcaacctgccgtggcatctcccgcaagataatgcagcaccacgaatccgaattttgcagcagtcatgaatctccttcagcggtatcagcccttggcacgcaaggcacgtaccagaagcgaacacaacgtagcatttcgcatcatcgtgtatttgaatcgaattgcagggctcaatgcggaaacatcaatctgatccaatcgtggccccaatgcctgtgcacgagtccgagccgcctgcttgacggattgggggtcggcgagcatgatgaccgccttcagttcctggaaatacaggttcacctgctcctcgttccaagcccgaagcaacgtcgcatcgccatcgagatggtactcacgcatgagtcgggcacgctcgtcaatggccggatggtatagacccctggcattgtttttgtaggtgcgcgcgctcaatccgcccatacggtagtaataccctgcataatccacatacacaatctcgtgcgccagttggaaagcctgcatattgaacagattgtcttgcatgcgaggcaatgctgcgtcgaactgcagtccatgctcctgcaggaaagcgtgcctgtacagtttgccccacggcactccaatggccgtgacgaatcctttgggctgtgcatatgaaccatccatcaattgacggaacagttccaccttctcatcagcggcacgggccgtgaaggattcagggaagaaatgctgcctggcggaacgctggtcatcgaatgccacgcaggtgctcatggcgatatccgtattacgttcggtggctttcagcagggtgtcgagatagtcaggagccacataatcatccggatcgatgaagcacacccattcgcctttggcatgagacagtccattgttacgggccacggatacgccggaattgttctgatcaatgagctgaacacgaccatcacgctgctcgtagccctcgagaatggagacggaggcatcggtggaaccgtcattgacggccagcacctcgaaatcctcgaaactctggtcgaggagcgaatccatgcatgcgcctacgtattcttcctggttatataccggaatgatcaccgagatctcaggcatgcccctcactcccctcatgggtcaatggcgtacgagccaccaatggcagactgctcatacgtctactgtaacgccaaatgaagctggcatagccgtacgcggccacgagcaacaggaacgcgcaattctgtaccggcgcagtgatgaacacgatcatcacgaatccggcgaaataccacatgtgccaatcatgggaacctagcaccagcagcacaaatggcacgatcatataaagcgccagcactaatccaccatggatgagcaggaacagcaaaccactggtatatcccatgccatcgcggtaggcgctcatataatgcgtccagatgtactcgtcggaatcgaatccgaatcccgtcagcgggcgctgccaccaaatacggaagccttcagtgaaatcaagcaagtgggtttggccggaataggacgtggccattttggagattacaatgcgcgtgcctgcgaccacggcagcgatggacaccagagccgcaacactgagcaacgcatagcgcaatcctctgcgctgtacgtgaagcatggccttccatagcaacggcaccaacagcaccaacacgtagagcgcacccccagtggacagggatgtgacaagtgcgccgataatgcagagatcggcgccccagtgcactttcttgcctatatacaagtcgatggcgagtaccataccgtaaaaagccacagcgcagggtggttcattgaaaatcgacgagtttctccacaccgtcatgcccagcacatgagcatcctgcacattgtagtacacatctgcgtacgaatagatcggtggtacattatgcacccaactcaatcgctcgacgtgcgaggggggcagcagaaggaaggagctggccgcccatagcaccactgatatggcggcgaataccgccgccaccaccaccaaacggttgagcagcaccttacgcacatattcgtggccacgcatgagcatgcaccccatcaatgcaggtacgatgagcgcatattggaaccaggtgccgttcgtgtaccccgatcccccatgagacaccgccattaccaactgcccaatgacggtggccagcacgagcacgagcatcgcagaccccacgcgatgcagacggtgccgcgcctcgcgccaacaacacagcatatacgccatgcacacggcgagcaacacgaagcacgagagcgagaaattatcacccgcaagcgcccacaacgaattcgagttgtagatgatggcgagaacaagcgcgtaatccatcaacgcgttcaccacctcacgaattcgcgggctatattccgcctgccgttgaacggtttcggtggtgtctgtcacttcctatactccacaatcttcatcttcatgccatcgtgaatgccccgcgaataggcgcgcagttttgcaatgcgatggttctcgaacagcaatgacaacgccatgagcaacggaatttccgtaagcccctcgccaccggtgtgcctatggtatttcttccaatacacaatgcggttgcgtgactggtagtagcaacgcattggcgaatatccgagcttatacagcggctgccattgcacacccgccgacgtgttgcgaggcaccttcagccaggtacgctcggatttgcccttctcgtgcaacagatagacggtgttgtctttgacaatctcatagccgttcaatatcaggcgctcattgaaatcgaagtccacgtaatcgatgaacaagttgtcatcgaagccaccaacctctaaggccgctgcaacatcgaccaaggaacccgaagtgatcgcgccatgcttggcagcatgggtcagccgctccaacggcggcatcttctgcgcttgccactcctcctcggtcatgcggttgcggtcgagtatgaatgggcataccaacgccacggaaccggtgaggtgccgttccaactcgtcgcacatgccttccgtgggtacgctgtcttgatcgagcagcagcatatgcttgaacccatgctccttggcggcatccaacaacctgttcaacgcaaaggctatgcccctgttattcgggtcggcttcgaccctcagggtcgtatattccgagtccgcaagcgagcggatatccgcgacgttctccgatccattgtcgaagacgaacaccgcatccacttggctggcggtgttattcaggttcgcgcgcaaccgttcgagatcgggattataggtgactatccctgcgcaacgcatacggtaccctctctacagcttgtgttcgaacagcagcgattttacacgcgtgcgcagattctccttccgcgcactctgctcgggcatgtataccgggtattccttgacccgcagcttgcgcgcgttcacccatacgttgagcagacgctcggaaaggaatccgaagagccgctgattgtatgcgtcatacttcgacacatcgatgcggcgctcggcctcgtcgagaatacggaacaaccacgtcatataggcgtcgaaccgttcacccgacatgacgaacatgttgtaggcatgcagcgaatggctcttcagcagttcatcgagcgccggcacatactccggacattgctcctgcatgatcgagcgcacgacctccagatcatccaggttgtggaactgggcgaactggtctcctatggtctttctgagcacccaaggttcggggagcaccacatcgtattgttcgaggtcgcgcgagaattgttcggccggaacaatctgcgctttccgatggtcgatgtagaaataccggcggtagtgcacaaagccgatgttcgcgtcacggtcatcacggttcttccacacccaatactgcgcggtgagctcgcagaaccccggattcttggcagagatgttatcgccggtattgtcttttacctcaatggaggcatggttcttgaccgcccctgcaagaatgggaacatacccaggaagctggggtgcatcaaaatccttgtgacttacgatatacatgatcgtctcggaggaaacagacactttatcactccttcctgccatgagatttggcggcagccctctgaccattgcgattgccgatgagacggaatccgcaatcaacggtgaatcgcattgcttcaatcacatgcccttgcctgagcaaaccgccaagcgtgtacttgaccaaggagaatccttcgccagacaatgacgcatcgccaagaatgtctttgtgcttggcaatctccacgccctgaatgtagttgcgtttgtactgctgcttgaaggtgaagttgtgagaatgaatcaccgtggcgttcgcttcatacacgatcttccaccctgcatgtagaaagcgtgcggcaatgaacatatcttcgttggtcagcacatctgtttcgaaaccaccgacttccagatatgccgtacgacgataggctgcacacacatcggtagagtggaaggccttgatgcccaagctcggaatatcggccttggtgatcaccatggattcatcgccatacgagtacttacgaacgagtgcctctgccgggcgcgcatccttgcgtggaagttgacgcccatataccagcgccacttcatcgtctgcgaatggagccacaatcttcgcaatatagtcattgccacttggcatggcgtcctgcgtgaggaacagcacgaaatcaccagtgctctcgcgaagcatcgcatcgcgcgtaccaccgtgattgaaattcttgcgatcgatgacgatcagtttcacctcgggatggcgcttgatcatctcctgtgtgatgtcttcagacgaggagtctacaacaatgatctcatcgggtttacgcgtctgttgctccagtcgtgtaagcaacgtgtcgatctgcctgcccgcattcagcgtaggtacaatgaccgagattgcgccatccaccaactcgtttcctcccacgtctcatacgccattacactattcattccgagctccgggaacctacaggaatggtaacagcatacgctgattgcgttcagctcagctcaaatcgcagtggtattgcgtaggtttcatacatgtcaccttccaccttagaattcaccatcaagaagacgttggtagatggtttccttaccattgaccgtggttgggtaatcaatctgataggtcagtttgtttatgtaggtactgctaggaatccgcggctgcgcctcagtggaatccatttgctcactcagtgcaaagcgcccctcgttattcgctggtatggcatcaatcatggctgtgaattcagcatgacgtgtataggccaccgacaacatgacatcgagcatgaaatactcggggattcctttcccccgagtgacgaggtgcgtcagcgaacgccccgcgtaatcgaataacggattgccttgggtgctggcgatgaaatacgaagtccaatttctcgtgggattcttctgatgcaccggtatcgagtatatggggtgagtgaatacctcagggtttatgtcatccgtcaagtaaacggtggcatcgatccacgcgccgccatgctggtacagcagcgtgcaacggatgatgtccgagagcaccgccatcggaatctcaccacattccgcagcctgcacaacactctcatcgatggatgcgtactcatgtagattctgcttcgaaataacgtgaaccggatgcccattggcatgtttgcgaatgctgcgcacacacgcctggatgatgtccggagcctgattgtcaactccttgccaccacatgacccagatcggcgcattcgcacattgctgttcatcaacggcaggaatagacatgctgtatggaaggtcttccatcaatgtcgaccatgttgcctgtgatagatcggtatagtaccggtccacgcctatgcccaccgtatgtgccagataaccctccatggcaagctttggcccgaacaggcgccatgcgcttacgcattccttgcggtatcgtttcagctttgtccgaatattgtgaagctttcccatagccgccttccatgtataaaggtgctcggccttccgaggaaggatccaagcaccttgggtgttatcagtcacggcggaagagatcgcgcgtatacaccttgtcggcggcatcggcgagatccgactcattccatcggttcgccacaatgatgtcggaacgattcttgaaggcattgagatcatgcgtcacttcactgccgaagaactcggcatcgtcgagcgtcggctcatacacgagcacatcgatgcccttggccttgatgcgcttcatgatgccctggatgctcgactggcggaagttgtcggaacccgacttcatcgtgagacgatagatgcccacaaccggcttctccacaccctcgagcttggagagaatctgatcggcgatgaaatccttgcgcgtgcggttcgattcgacaatcgccccgatgagattctgcggcacatcggcgtaattggccagcagctgcttcgaatccttcggcaggcagtagccgccatacccgaacgatgggttgttgtaatgcgtgccgatgcgcgggtcgaggcacacgccgcgaatgatctcggcggtgttcagaccacggctttcagcataggtgtcgagctcattgaaataggccacacgaagcgccagatacgtgttggcgaacagcttgatcgcctcggcctcagtcgtgccgcacaccagttccggaatgcctgtggaaccatcggcgttgagtcgatcgttttcctctggagccgcgccttctgcaagaagcatcgcgaaggtctgggcggctttcaccgcctccgcatcatcggtaggagctcccacaacaatacgggaaggatggaggttgtcgtagagcgcatggccctctcgcaggaactcgggagagaagataatcttcttatcccccgtcttctcacgcaactgagccgtatagcctaccggaatcgtcgacttgatgacaatccagcaatccgggtcatattcacgaatcgccttgatggcggcctcaacgctggaggtatcgaagtagttcttcttcgaatcatagttcgttggcgtggccaccacagcgtaatccgctcccgtgtaagcaacagctggatcgagcgtggcctgaaaatcaagatccatcgtgccgtcgcgcttgccatcgaggaaacgagtgatctcggtatcgacaatcgggctctggcaattgttgagcagttcgaccttctcgggaacgatatcgagcgcatgcacctcattatgctgcgacagcaacaacgcaaccgacagtcctacataaccagttccagcaacggcaatcttcatagtagctccattttttatgttgttaatatgctattacattaatatattgaattatctgaaataactaatctgattattccactcacttagcaggagatgaacacattctaagaattcgagctatttcctcctcctaagcacattgactatataattcagaattggattcttgagcatcaccgacgacaagaggaatgatactcctcccatgagcacacaggttataaaagagaagaaaacatttttgataacaaaattgaatacttcaacaattattgtcattatcaatgttgaaacaactgttttccaaattacattctttcgtatgccgaaggacagagtcttgctagcgaaccacgccgtggtcgccgtaacaaaagtctcactcgcaacagatgcaacagccgtgccattctgggacaacaacggaatcaaggcgagattgagagtaatgttgattaatgcaccgccaatagtgcaatacagcagttttttctcttggtcgaatgccagcagtacctgagtgccaaataaattactaaaccctaatgcatagattagtagtgacataatttgcatagtaagaatgcctgcgctataggcatctccgaagagaataagaaccagttgtctagaggtgcatataagtccaatcccaatcgggagaaagcagaagaacaaaatttcaaacacacgacttacgatgctcgcacattcttcgtagcgtttctcgaccttataccgactgatgcgaggaagcaacacgcctcccactgcagtaatcactgtaatgatgatgcgaataattttatcagcatttgtgtaatatgcaactgctgcattattggacatcaatcccaatattgtcacgtcaagtaatgtgtacaacttaatcgaaatgatggttgagaaaatcaaaataattggcttgatatgttttttcaattcaatattactgaatcctaaaccaatattaagtttatgtaaatgtccgacattgaatatattattaagcccgatggcacacacgccaattagtgcataccagacataatcattttggctccgcacgaatacgaaaagcgctgcaagagaaacaagtttcacaataaaactgcgaaccgcgataaagctataatcttctaacccctgataaatccaatcaacattaatgtaattaaggaggatgctaccgccgcatacaatgtacagaaccaagttctctttgaaatttggaactacgaagatcatggcacagtatgcaatcgccgcaagagtagtggagattgcattgattgagatgagctctgtaaatactctctttgtcccagctttcgaatcccgcgcatgcgcaacttcacgtatcgcgtagttggggatacccagagatgcgaaaatcacaaaatacgctacccaattctgggccatcgccaccaaacctacgcccgacggcataagtacacgtgccacatatgatgcagaaatcagcggaaatataacattcaaaagctggtaacaaacattaaaaatagagtttttagccagtgagttactcatatatacaccaattaagctattctacagaacagaaatccctctcacgcttaatgcataaaaatagaacgaacatcttctataaatttattcttctctgccttaatcgttgacctgtacccatcaaagtcacgcatccttcgatcatagtcgacaaggcattctcgtatcgtctccacaatcgcaggaatactcgtgacggaatcctcgaactgatattcctcgggaatcggaacgtcatcatatgcagccgatcctcttttcccggtaatcacacagcatcctgaaattgctgcctcacgagggaatctatctttaccggggtgatctccaaaatctatatagaccttggaggtcttcaattttccccgaacttcttcattactcatgttctccaatggaacccagttcagatcaggagcagcttcaatcaattgcctagtaaattcaatacctttttttggattatataacaccgcattattgcgatatgagatagaagtatcttcttgatattcttcattaatgtagtcggagagatatacgatatttgtaaaaccgcgtttctttagataatcctcggcataatacgattgaacgagattcttacttacattcttgcgtatatacgaaaacccgtagcgccaaaaaccatgctttgtccatgtaagaaaatacctagttaacttgttcttaattatataatgtaaattataccttttcaggtaattatctacactcaaccaccagcaatacttggtcgcattctttagaaaatgaatatcttcgatgttgacttcgggaaatacgacaatcgaatcagctctatcaggaatctgttcgaataaacaatacttcttcacatattttttgaaagctgcgtttacaggagagagtttatcttccttattataggctgtgtaagcaattatggccttcaccccattattattaagaacatgcaccaattggtgaagcaattctgggccaccactttttgaatacgcaggacaaaccacgtaaatagcagaataagcattattagagacagtcataattttataatccttcatacataaaaatttataaattcaaacagattgcttatcaaaatttattaaacagagtacgtgaatctctgatagctttcagaatcgcccgcacacgctgaattcgatttgggtcgaatacaagggtatgcacaatagcggattgaggtgattgaagctggatgtgcatccttttcaggaaggagccgtatttttctcgcacataaaggagattacgaatttgatagtaagtgcggaaaaccgaatgcccgctcctatgaccccgccgaataacaattttcccttgctgtattcttgggaaaggtaatccagatggttctatatgcccaatttcatgagtcaaaactaccgtattgatacgataactacaataccccttcatcaaagctcgaatatcatactccgtatcaactagatcaatgaacagcttttcgtcaaaccctccaattgctttccatgcgtccaagttggttaatgaaccagatgtgatagggaggagacacacttccttctctggtaaatcgcttgtatctactctgacattgatgtcggaaataattggtgacacgattgctacgttatccgtcctatatctaatcaggttactgtacatgttctcacatgcctcgctgtcctgatcgaggagcagaatatctctctcatctctttcaagggcataagcacatagacgattcaacgcgtaagcaacgcctttgttgctgccctcggtagcaatgtgtatcttatcgctcaaagaggcagcgagtgcaatcacttctttgtaattgtctgacccgttatcccaaacaagcacactacccacttgaggaaggattgcattgaaatttgcttctaaccgttttaaatcaggattaaaggtggtgatcccgcaaacagacatattttctcctctgcaacacttaagtatactctaaattactacacaggtttcaaaatatatcaagatcgtgtaattagttagaactacttttaactagtaagcgccactcgggtgcagcactgtgccaatcgtgcgcagaatgtacacgacatcacccatgacgctccagtcctgcacataactcacatcaagctgacggctctcctcctcattgaggtcattgcggccggacacctgccagggaccagtgatgccgggcttgaccaacagacgtgtcgcatagaccgggtcatactcggccacctcgaatgaacgttgcgggcgcggccccaccacactcatcgaacccataaacacatcgaagaactgcggaagctcgtcgagactcgtcttgcgaatgaagttacccaccttcgtgatgcgcgggtcgtgcttgagcttgtaccgggctcccaattcctgcccttgcgcagccaatacctctttcaggtgtgcgtcggcatccacacgcatcgaacggaacttatggatatagaacggcttgccgcgcaagccgatacgctcctgcttatagaacaccggaccgccgtcttcaatcttgatcgccaacgccacgatcagcatgatcggcgagctcagaatgatcgcaatcgtcgacaccacgagatcgaacacgcgtttcttaatctgtgcggagggggaatactgaggcagactgatcgtcatgatgctcataccctgaatgttgcgcatctgcgtggcatgctcggcaatgtcaagcgcagaggtgatcagcgcaatctcaagattcacggattccatctgcaaagcaaaagtgctcagattgtcggagaatcggtcgagcacatcggtgaccatcaccgtctgtgcgccggtttccgcaatccgtccagccagctggggtccatattcaatcacatcaatcggggaattccatgactcatgcacttccttgctgagcaattcggtgttcggatccgcctcaatgagccccgtctcgctattgacccgaatcgggcacaggcgaattggcttgtaattgagctgtctgcgttgattgaggaacttgagaatctgcccaataccctcgggggaaccgacgatgacggtcgggtacgaatactcccctttgcgatgtttactggtgagaatgacgcgcgcgatgaagcgaacgatcatttccgccacccacacaatcaacgaggtgaggcagaccatgtagaagaatatgttgcactgaatgatgaaattcagcgcgcaaatcgccacccaggcaatgaagccacccttgagtagcaacatgttgagctggtatccgtcggcgaacacatgccggtggtacacccccgccacatgcatgcagtagacgtaaatcgccgcgcaggcagcggaatacagccacgggtctatcggcagattcagttgcaaacgagtcgtcactagattcgtgccatgcgatacgaccagcacaatcatgctggtagcgaagtagaccaacgcatcgaacagcatgagtgccaggttcatgacgaaacgccatcgcagcaccctgctggagcggacgtccacttcctcagcgagctgagcatcgcttttcgcctgtgccatggctctccctcatacatgccgtccgtggctcttacctattcaggactcaatacagatgtcaatcatatcgcaatgctcacactgcacaatcagcgacctggcccaccggctaagttcacgagcagtgaatagtacaggccagttctagaataggaaccagatggttgtatatacaccgttctcatatacaatctgagcatccgggtatatcaacctcgccacacgtacagcatgaatcggccgatacggccattcgtcagataaaggaggagacccatgaccaccatcaatgactcaccgatcaccaacgattccgacaccgagcttgaggcatttgaacagcgcgtcaacgagatgctttcgaccggcgaactcgactccgcgctttccatcaccgatgagaacggcgtggcacaggtactgccgatgctcgacaccgagccgatcgcgcatctgctcgacggcattgaggagctcggcggctcggccaacgtgtttgtgcgcaccgccgaaggcactgccattctcaccgtgaacgagtacagcccggaagacgccgcgcttgacaccgcagaaagcgaagcggatgccgaagcagacgctcagtccgcggaataaccgccgcggcgattccaagcgcgccggcagaacacacagaaccatgcagaagagaacagggaatcacaagcgatgaccagccacgagggacccgaggagggcgagcaacgcggcgggaacacggtgaccgcagccggcaaaccatacacccgcgatgtgcatcacgacacagaaccagctccccctcgggcttcgggctacttcgccggactcacccaggcactcacgcgcaccgatgcataccgtgacgggcatttgagccgacccgcgttcctctcgctggccattctcacgttcatcactttcgtcggcaacttcacgcagctgcagctgagcgccgcgctgcccaccttggtgagcgacttccatatctcggtgacgctcgggcagtggatgacgtcgattttccagctcacgatgggtgtcatggtgccgcttaccgcgtacctcacgcgccgtttctccacacggcagatcgtcatcacctcaatggtcgtgttcacgctcggctcggtgctggcgtggctcagcccgtcgttcccgttggcgctcttcggccgcttccttgaggccgtgggcaccggcgtgatgtggccggtgctgcagatcactgtgttctccattttcccgctggcacggcgaggcatggcgatgggcatcgtcggcatggcgatggccgtggctccggccatcggccccacgctcggcggcgtacagaccgatctgaatggctggcgctccatattcctcaccctcaccattattggctgtctcgccattgtgctcaccaccttcggcctgcataatttcgggcaggcagacacatccgcgcatgcggacttcttctcggtgggtctttcgatcatcggcttcggcggcctcatgttcggtttcacgaacattcaggcctacccgttctccgctccggtggtctggctgcccatggccatcggcctggcaggcatcatctggttcgtgctccgccagttccacaccgagaagatgttcaaggcaggcaagagcagccgtcccgccctgcttgacctttcggtgcttcgcaaccggagcttctcgattggcacaatcatcgcatcgctgagcttcttcgcattcagctcgctcattgtgctcattccgctcttcattcaggattgccgcggctacagcgccacaatcagcggactcgtcatgctgccgggcgccattgcccaggcaatctcgcagttcttcggcggacgcgcactcgaccgcttcggcgcgcgccccgtggccctcatcggcacgattctgcttacggcaggcactgcgtgcatgagcacaatcgggttgcatacatggatctggtccatctcgttctaccagttcattcgccagatcggcatgggcttcgtcatgatgccggtgaccacatggtcattgaactgcctcaaaccctccgaagtctccgctggctcggcagtcacgaacacggtgcgtcagatcgccggcgcagtcggctccccggtgatgattctcatcatgtattcaatcactgcggccagcatgtccaacggacagcagaccattcccgccaacatcaccggcatagaatgggcactgcgcatcagcgccgtcatcaacttcatcatgattctcatggtcgtcttcggcgtcaagggtgaagatgccggctcggcccgcgaagccgtccgcatcgcgctccaccacgactcgatagagcaggaagacaagggcacgaaggccctcgcccataccgatgacaccgccaagctccgcaccatcgagacgggtaaataggcagaaatacacgtgacgggaagcgctgggtcggggatccctcgctgaggagcgtgatgcccgccgcatgcggcgaagccgcaccgcggcagcatttcaccttgacgaagcgtgggatccccgacccagcgctttcctcaggctttgcccattagggtgagcacgatgagcacaaggttcagggcgatgatcacggcaaccaccaacaggcagatggcgtgcttgacgggtccatccacgtacttacccatgatctgtttgttgtgcgtatatcgcatcaagggaatcaccgcaaacggaatgccgatcgacagcaccacctgacctatgatcaacgcttcggtggggttcgaggtcagggcgagcaccaccaacgccggcacaagcgtcgtgatgcggcacgcccacatcggcacgttccagtgcagcaaccccttcataatctccgagcccgcataggtgcccaccgaggtcgaggaaaggctggaggcgagcagtccaatcgagaacaccgtgccgacggtagggccgagcacctgtgagatcgtgtgctgcgctccctcaatcgtgtcggtgccacccatgccgtgcagcgaattcgccgccagcacgagcagggcgatgttcaccgaaccagcaagcgcgagcgcccacaccacatcaatgcggctgccgtgcagcatctccttgatgctgggcttatgcgccttatgcgcgtagtggtcgttcaccagcgtggaatgcaaatagatcgcatgcggcatcacggtcgcaccgagcatcgaagcagccatgagcaccgaagcgcctccgttgaaccgcgggatgagcccttcggccaccttgagcggattcggcggatccatgaacaggccggcaatgaagccgaacgtgattacgagcagtaggccgatcaccagtcgttcgaaaatcttatgggtcttccctccttggaacagcagcagcacggtggagacggcacctatgatgagccctcccacgagcaacggcaatccaaacagcagattcagtgcaatcgcgccaccgatcacctcggccaagtcggtggcgatcgcaatcacctcggcctgcgcgaagaacaggaagctgccagcactgcccatgcgttcaccgagaatctgcggcaggctcttgccggtcacaatgccgagtttcgaggcctggtattgaatgagcacggccatacagttcgcgagcacgagcacccagacgagcaggtagccatattgcgcccccgacgtgagattggcggccacgttgcccggatccacgtaggcgaccgcggcgatgaatgcggggccgagcatgctggcgagcgcatggatgggcttctccggtttgccggaatccttgcgcgctatcgcgacatcctgatccgccacggccgcctcggccaccgtgtcgatgtccaccaccggctcgccgctcaccattgccgattggctgcctgtcgcgccttcatcccgttccgccatgctcccaccacctcactcttctgtgtcgttctgcttcaggttgccgttctgcttcaggttttaggcggcaattgcaaccaagcgaaattcgttcgcagtgcgctcaatcggcgggaatctcctgccccgggcatccatgcagcacactttgcatcgcacgcttctcgctgctcgtcaccgagagtccgtatttgtctttcacaccgatttgccgggccacgtaatcgcagcgatacgaagcgtttgtcggcagccagtatgcggcggaggcggagcctttgccttggttcgccgggccatccacggcgagcagattatacggatcgttcgcgaactgcatgcgttttctcgcgttccaatccttggccccggattgccatgcgttctgcaaggcaaccacgtgatcgatctgcacggcggcactcgtgttctgcccgcgtgtgaaatgaatcaccttgcccgtgtacgggtcgttcagcacaccggatttcaccttgcagccgttgcgcgtgacatatgccacatcagtcagatcgcgcgccagaatgtcctcgcgcacatcgcacccgttgccgtcgtcgtcggtctcgcggaatccgaacagatcgcggtcatagccgtcgccattgggcctgtccaccacggcgagcttgttcaacgtctccgcagcggttccagtggccgtgtatctgccggtgatctcggcgatgccgttgttgatgcgcggcagaatcacgccgagggttgctccgaccaccactgcgatgagcaggatgatcaggattctctcgagcggtgtcactccgtatttgcgcttgaatcgtcgtgccatacgcacagtgtaaacgcgcacgttcgcaaacaacagtcttgcgtgttcccgagtgttttactgccgcccgcgttcacaatggggacagtttcccgagatatgcgtgttcgtgtgctaattgtcgtgttgacacggaagcacagtgagggaagagactcatggaaaccactcgcaacgaactcaacaggaacctggcgcagatgctcaagggcggtgtgatcatggatgtgaccacacccgagcaggcacgcattgccgaagatgccggcgcgtgcgccgtcatggcgctggagcgcattccggctgacatccgcgccgccggtggcgtaagccgtatgagcgacccggcgatgatcaagggcattcaggaggccgtgtcgattccggtgatggcgaaggtgcgtatcggccacattgccgaggcgcgtattctgcaggccattgagattgattacatcgacgagtcggaggtgctctcccccgcggatgacgtctaccacatcgacaagcgcgaattcgacgtgccgttcgtgtgcggcgcgaagaacctcggcgaggcgctgcgccgcattgaggagggcgcttcgatgatccgtacgaagggtgagccgggcaccggtgacgtgatccaggccgtgcgccatatgcgcacgatgaccaagcagatccgcgaactcgcctcgctgcgcgacgacgaggtgtacgaggcggccaagcagctcgccgtgccgtatgagctcgcgaagtatgtgcacgataatggcagattgccggtcgtcaacttcgccgccggcggcgtggcgacacctgcggacgccgcgctgatgatggagcttggcgccgagggcgtgttcgtcggctccggcatcttcaagtccggcgacccggccaagcgcgccgcagccattgtgcaggccaccgcgaactggcgcgacgccgatttgctcgcgcgcctgtcggagaatcttggtgaggcgatggtgggcatcaacgaagacgagatcgagacgatcatggccgctcgcggcgaatgacacgatactgctgttgaggactattcatggttgttgacgtttcctatatctcgaaggaacactcggaggatgccacgacggcatcctccggtgtgaccggcattctcgctgtgcagggcgccttcgccgaacatgcggcgatgctcgacagactcggcgccccatggaagctgctgcgtgcccgagaggacttcgacgaatcgattgaccgcgtgatcctgcccggcggtgagagcacgacgcagggcaagctgctacgttccaccggtctgttcgagccgatcaacgagcatatcaaggccggcaagccggtattcggaacctgtgccggcatgatcctgctcgcgcagcggctcgagaacgacccgaacgtgtacttcggggcactggacgccaccgtgaggcgcaacgcctacggtcgccagctgggttcgttcatggccaccgagaatgtcgccacattccacgccgatggcactccggctggcgtgatcgagaacttcccgctcgtgttcatccgcggtcccttcgtcgccgagaccggagcgaatgctcgggtaatgtgtgaggccaacggcaatactgtagcgttgcagcaaggcaggattctagctacggcattccatccagaaatcactccggatacgcggattcacgaattttttctaatcatatgagaaataatttatttgccctgaactaaaaccctaaaagggcaacgcttaacaactctgctgttgcgatcagcatgataccaacagcagcagtggctctacgataccactccaacaccacgaacagctggtgttgcagagcctcttcccacccttcagattgaccataatcaaaaaattatatatatatcttgtattattttctattcaatattcccattaaactcatgtgctttcgtctatagcgcggagcatactttgatataatgtagttgctcaaataaatcgaacctaattcaccctcttatcaaattagagcaacaaggttttaaggattgagagaatatgcaagtgtcaagcgaataccaggatcccagcatcgcgtctgacggcaatcgttctgagctcgactcaaattctagtccggcgcagcaaaaaacaccggtggaactgagcggcaagactatcctcattaccggtgcggccggatttatcggctggaatctggcggaacgtctgcttcatagctatccggacatcacaattgtcggcttggataacctgaatgactattacgacgtcaaattaaaggaagctcgtttggaacgtctgaccaaatatccgaatcttattttcgaaaaaggcgacctctccgataaaaagcttatcgggcggctcttcgagaagcatcatttcgatgttgttgtcaatctaggcgcgcaagcaggcgtccgctattcaattacaaaccccgatgcttacgtaagttcaaatctaattggtttttataatatcttggaagcctgccgccataatccagttgagcacctagtatatgcatccagttcgtccgtgtatggtggcaataaaaaagtcccattctccacggaagacaaggtggacaatccagtcagcctgtatgcagcaacaaaaaagagcaatgaacttatggctcatgcctattccaaactatatgacattccctctacaggtcttcgtttctttactgtttatggccctgctggtagaccggatatggcctactttggttttacaaataaacttcttgccggcgagaccatcaagatcttcaattacggtaattgtcagcgtgatttcacctatattgatgacatcgtcgaaggaattgttcgtgttatacagggagcaccaactcgccagacaggcgaggatggtctgcctgtacctccctatgctctttacaacattggttgcggccatcctgagaaccttctcgactttgtaacgactcttcaagaagaattgattcgagcagaagtgcttccggatgactatgacttcgaagcgcataaggagctcgtccccatgcagcccggtgatgttcctgtcacctatgctgatactgaagccttaacaagggattacggctatcgtcctaccacgagtctccgtgatgggcttaggcgatttgctgagtggtacaaacagtattatatgtgaattaatactatactgctctttctcgcattaccggatactggtactatccctacagaacaagatcgacgcacatatctatatatgattcaagggaagtaagttaagtggttcataaaagaaaaccccgtctttgttttgtctcctcctccggggggcactgggagcagctccagaaactgctcccactggctgaaaaatacgaaggttttttcgtcacagagaaaacgcaatttgagacgccacgcgccaaatatttcatgaagcagacggatttgaaagacaaattcatggttccaaagatgatcgtgaactcggcgcgcgccctggtcatctggattaaagaacgcccggacttcatcattacaactggcactatggtggcatatcctttctatctccttgctgtactcttccacaagaagtttatcttcattgagacctttggacgtgccaacatgcccaccgaagccggtaagaagatggagaagcattccgatttgttcatagttcaatgggaaagccaaaagaagttctacactaaggcgatttatggggggtgtttatactgatgatcttcgttacggtaggctcacgcaattatccatttgatcgtctatttaagaagctggatgatttatacgagcagagtgttctgtccgaacctatgttcgctcaaattggcacttcatcatataagccaaagcattaccagtatacggattttatatcaccagaagagtttgaagagaaaatccaggaggcagacatcgttgtaactcacggtgcttccggctctataatgaaagccctcaatgcaaagaaaaaggttatcgccgtaactcgtctggccaaatacggcgaacacatcaacgaccaccaaatccagaacaatgaagccttcagttcgaatcattacgtcctaatggctgaccccgagttgggcaaccttgctgaatgctttgagaaaatatacatcggaactgatggcctgattccttgggagaacaaagatccgttatcgattgtcaaaatcattgataaattcattcagaaggaatggtacggataatcctctcctagttcgattgaagaaccagctagacaatccgataattcattatcccgagttcgtatggagaaactacattgaaagcttccgttgccgctggcgtagtgctgttcaacccagaggatattaatagagttcagcaatgcatcgctgccattcttgagcagactgaccatgtttatgttttcaacaatggtactgtggatgttccgcttgccgaggatgctagaatcacatatctctcagaaaatgcaaacaaaggaattgcctacgctctaaatcgcatcatggaatgcgccatgaaggatggacatgaatgggtgttgacaatggatcaggattctattgtccctgacggcatggtggacgatttccgccgccttattgagaaggatagggacaagacagccatattttgcccccaagttattgacaagcgtcgagcttatatgaagacggctgatgataataacgttattaaaattactaaatgcatcacctcttcaagctgcacatccacaaaagcgtgggaatgcgttggcggatttgatgagtggctattcatcgatcttgtagatgatgatttctgcagaagacttatagcgtccggctacaccatcaaacgcgccaataaatgggtgctggatcaagaattcggaaaaatcgtccccaaatcttctcgaaaacaacaattttggattggcctcagtaatttattgcataataagaatattgcaaaattttcatataataaatatgtaagtccacttagagtgtactatactaatcgcaatattatatacgtgaatcgtaagctaaaaaaatacggaccggttggttacatcaactacaattgcaaaggttatttaggttttatattttgctttaatttgccaagccttcttcgagcccggcataaaggacaggtgctatccgcaatcataaagggcacacgtgcaggattgaaaacatacccctctcaatgggttgctccgaccataacggaggcagcaaaggaacataatgaatgatacaactgccagacaaaacctatttgcaggaatagttactttcaatccagacattgaattactccgcaagaacatcgaggctatttgcgcgcaggtcgacttagtgattattgtcgacaatggttctcgtaatctagaagatatccgacccctcgctgacgcccatcattgcaaattgattcccaatgcgcagaatgaaggcattgcaactgcgctaaatcaaattgcactagccggaaagggcgatggctattcctggatgctcaccttggatcaagactcggaatgtcctccagatttttgttcgacgctttcacagtttttctcaatgaattccagaatcgctatcgttgctccagttatacaagatcgtgatcggggcattatcggacacaaacccgcaggtacatacggggaagtgcgaacatgcatcacatctggctcatgcactcgtctctctgcttgggaaaaaatcggaggttttgacgagaagttgtttatcgatagcgtcgatttcgatttctgctatcgtatacgtaaaactggatatgtaatcattcagacgagagaagcagtactggaacactccattggagaggttaagaaaaacaaacttcttggaatcccctattccgagcattccgcatttaggtactactacatttccaagaacaacatatattatccattgaaaaacaggttgtatctgcatgctcttcgaggtaatgctcgaaacatgagaaatcttcttcaggtacttttttttgaagaggataaaaaagctaagcttaaacaaattgctcgggggtgggtcaacggatacaaatagattttcttatacccggttatcggtagtacatgtttaagaatgtagatacgtctactttcagcacctccggtgcttctctgacgaaaggactaactgtgcaattcatattgcacgccgtacgcatagcgtccgtagctcaaccagacatcatagagtagtcttgcgcccgattttttaggatcaccatgattcaagctgttagttatttcatattattgtctatctccttctttaaaagaaaaagttatattctgtactttgtttgcatagtattcctttggcttattgcctcttttactacagggaatgcagatgaacagatttatcaaagccgttatgacgaatatcaattatgggaagataacactgaatatctgtatatggcgcttatcaaaacatgcaatgctttgggattaacgtatcaggcatttaaatgcgtttctgccttcatagtgctgaccttaatcagctgcacaattcttcgatttgctgcatgcccgatattgactctgctgctttatgcggtgtatcctttccctattgacgtagcccagatgcggaattgtttggcaacttcagttttcatcttcggcatgggcttcttactggacgacgtacagaatggcgacaatcaaggaagattcctgaccaagaacgatatcctgtattgcctatgcatctttatcgcaacaatggtacatactgcagcgttcttctggattatcattctcgtggcaaagaagcttaataccaagtgggcagcgattttcacatttgtgttctgtctgctgttctcagccataatgaccccacgctttatctcgggtctgtcgggtttattcggctccaatgaccgaattaacgcttacaccactgcggcctacgatctgactcgtgatcttcatttacctctcgctttgctgcgtgttgctatttttttcattacatcattggcggttctactgattactaatctaagcagcatgaaaatgacaggagtgcaaaagaaagaatacatattctatttcaaaattactatattaactctatgcattcttccaattacgataaattacactcccgaaatttatcgaatgcaaactgggctctcgctaatcttctatatgattatcctcaacatcatttcaggcgagacaatcaactccacgaacgacgcgattctcagattcatcattccacttcttttgctagtatttggtgtcgtcaatgcgttccttctctatatatttggagataatttagagacagtatttataccaatttttgaaaacaatacgttcttcaactctatcgtctaatgaacctcgctctcatatataatcaaggaaacttcttcttgccgataatttgaagtagtcgtcagcaataataaaatttctggaaaatagcagagaatttatttaatttacataaatcggattttcatgctttatgaattccatcagcgatccgcatcgtcgaagctcggtgagaaacaagcacaacagccgcatcacgctcttcgaccagagcgttgatcgactgcaggatataggcctcgttgagtgaatccaggcgactggtcggctcgtcgaacaggtagaggctcgcatcgcgcaggaacatgcgggccaggccgaggcgctgtcgttcaccttccgaaagccgatcaccgagttcgcccacacgcgtctccatgccctcaggaagatcatccaccaaagcagcgatggatgcctgctccagagccctgtgcaattcgtcatcgctcgcctccggtttggcgatgcgcaggttgccggcaatcgtgtcatcgaacaggtacgtctcctggctcatcatcgtctgcaaccgcctacgcgtatgcgcatcgatggcaggcaaagcatgcccggacattgacacggtgccttgttgtgggtcccagtagcgcatcagcaacttgagcaatgtggacttgccacgtccagacggtccctgaataccgaggatcccggagagcgggatatccatcgtgacatcacgcaacaccggcgcaccgtcaccatagccgaacgtcaccccgtccaacgacatgccgtcgtatgcgcattgctcggttccccgctcttccactgcaggttcggcgtcgagcaccgagaacagtctgcgtgcggaggcgaaggtctgcgtcagattcgccggcaacgcgctcagtgcgagcgtggggccgaaggaactcaccacgagcacgaatgcggcgatatttgcagcagcactcgtgttgccaaggctcaatgtcaacgccagcaatgccgccacggccgtcaccacaatcacgatcatgctgtcgtagccgctgaatgcaccgttccgcgcactcaatctcgtgcgctggcgccacaatgacctcgaccacgcatcaatccgcttcagccggtcgtcaccacaatcaaagcgaatgatctggtcaagcccatgcatgtcatcgagcacttgatcgtcaagcgcagcgctgtccttgcgcagttttgaacccacaccacggagcgcggcagcgaacagacgcggcatcagcacgccgagcagcagatgcgcgatcaccagcaacaatgcaaaccaggggctcaggaacagcaacgccaccgtataaagcacggtcgtcgagagcgcgataatcgtcggcgagatcgtgtgggcgaagaagatctcaagcaattccacgtcggtggtgatcagcgagatcatatcgccgttgccacggttcgcaagcgcagccggagcgagtctgcgcaatgcgtcgaacgcacgttcacggaacaatgcgagcagacggaacgccagattgtggttcatgtactgctcgcagtaggccatgatgccgcggatcgccgcacacaccaccatcagggtcacggcccagccgacagacaaaccccacaccgggtgaccaaacgccgcgcacgccgccatgatgccaaacaccggcatgaacgtggccgccaagtggccgagcacaccaaagcagcatgccaacaccatcaacggacgcaatgaacccacctgtgcgagcagacggcgaatcacctgcacggtcgtcatcgcatcgtcggcagccatatcaatgccggaaagcgcagcgttccgtttcccagcagattccgcaacacgcttcggcatgtcgccgcccacttcgttctgcgtgtgcgcgtagcgtatgccgccgccttccgtacgccgatgcacttgttcgacggtggcctgggcgtggaacatgcgcgcatagcggccatccgcagccatcaatgtgctagagtcgccggtttccacgcagctgccgtggtcgaagacggcaatcatatccgcgtccaccgtgtcggcgagtctatgtgtgacgacgatcaccgtcttcgactgcgcgagctcgtggattgtctgcatgatgagcgcctcggattcggcgtcgacactgctggtcgcctcatcgaaaatcatgatcggcgcctcatgcagcagcgcgcgtgccacagcgatgcgctgacgttggccgccggagagattcgccggatcgattggcataccaagccctgccggctgctcgcgtacgaaatcatcgatatgcgcgagtcgcaacgcgtgatgcagttgctcgtcggtggcttgcggattcgccatgatcagattgtcgcgcaacgtccccacgaacagatggctgcgcgcaccgacgaaggagacggcagccatcagtgcggattcggatagatcagccacttcgacggattcaccatccacttcgaaggccaatgagccactgtacccttcgagttcgccggcgatgagcgcggcgagcgtggacttgccggatccggattcaccgacaatggcggtcagcgaatgtgccggaatgtcaagcgagaccttgcgcaatgccggttgggcatctgcttcgtcgtctccatagaagaagcccagattatgtgcatgcacggaaatcggcccggcggggagcgtctgctcaccatgatgcggagctggtgcgtcgagcaacgcgaagatcttcttgctggaagtcatgccgttcatcgccacgtggaagaatgaaccgagctggcgcaacggcaggaagaacgatgcggagagcagcacgatgagcaacatgcccggcgagccgagctgcggtccggcgaacatatccagtggcgcgaaggtggtgcggaacatcgtgacaccactatgcgtgagctgccagattgccacgccgatgccagccgccgcaccgccataggcaacgacatccatggcggtgagcgagcgtagctggatctgcagcacgcgcatcgtcatcacacggaaattctcggcctcctcgtgcatcttcctggcggccgactcgtcggcatcgaaggtcttcagcgtctccagcccctgcagattgtcgaggaacgcggagcccatatcggtgtacttgccccagtatttcttgaacacgcgggacgcgcgcatggcgaccatgccgacgatgatcacgatgagcggcgcacaaacgagcagcacgacggctgtgggcatattgatcggcgcaagcacggcaaacaacgtaagcggggcgagtacagcgtagaacagctgcggcacgaacttctcgtagaaactctgcacctggtccacgccttcaccggcgagctgcacaatgctcgccgtgctcgcctgctgacgatacgacgggccgagcacgagcagcttgcgatacaacgcattgcgcaagccgagtttgacacgctcggccgcctcggtgccgaaccgtgaaccgagatagtgggcaaggaatcgtatgaacgcgatgactgcgaatgcgagcgcgtaccaccccagcgacaccacagtgaacgtatatgcggtattgcggcccagcactgcgcccatcaacgacacagcagtgacagacaacgcaatgtcggcgagcagaccgacccacaggcacaccactttcgccacgatgagcccacgcacgccgggagcgaggggaaacaggcgcttatcgaacatccgacactccagttcacatttcgacttgagaaaaccatgtgccaatctagcagccgaatcgcgtttgcaacagaccccggcgcgaaaaacagctgattgtgtgaatctgacaatcaatttcgccatgcgttgtcggagctcacaaagatttgctacgccagcgtaacttagaatgcttgaggatttgctcagcaattcatgcagattgtttgttatttgccaagacaaggaaataaggcatatgctcaccgaatacacgacgccgggtcctgcgctcaccgtgcgcaatgacgagaccatctactctttgctcaccgaccgcattgcacgttccggcgaggactccccgctcaccgagaacaaggaggccgacggcgcgtggagcaagctcactgccgggcagttcaatgaccgcgttcgtgccatcgccaagggtctgattgcattcggcatcaagaagggcgatgccgtgacgatcttctccgccacgcgcgtcgaatggggtctgcttgatttcgccctcgctgcagtcggtgcggtgaccgtgccgatttacgacaccgattccgcggcgcaggccgaacgcattctcaacgattcgaacgtgaaactggcgattgccgacaatcaggagcgcttcgaccgcttggattcggtgctcgaccactgcccgtcattggaacgcattctgatgctcgacgcgaatgccgtggaagcgctggaaggtcttggtgtgatggtctcctcggaggaactcgacgagcgcattgcaagcgtgaacgccgatgatctggcgacgatcgtctacacctccggttccaccggcactccgaaaggcgccgaactctcgcacaggaacttcgtgagcatcacccgcgcggccgccgactgcgtgcccgaagtactcgaaggcaattcacgcctgctgctgttcttgccactcgcccactgcttcgcacggttcatccagtatttcgccttcacctccgatgccggtgtgatcgggtatctgccgagcacgaaaacgctgccccacgacatgcaggtgttcgaacccaccttcgtgctcgccgtgccgcgcgtgttcgagaaggtctacaatgcggcatcgcgcaaggcaggcaccggctggaaaggccgtctcttcgccaaatccgtcgagttcgcccgcgaatggaccgagatggagcaggccggcatcgcaccgacgcccaagcagaaggcggagcatgcgatgtatgagaagctcgtgtattcgacgatccgcagcgcattcggcccacgcatcaaatatctggcctgcggcggcgcaccgctcgaccgtaaactcgccaccttcttcaacggcatcggtttgacgatgatccagggctacggcctgaccgaaaccgccgccccattcgccttcacccgcgtgcacgataacgtgataggcaccgtcggacagcctgtgcccggctcctcggtgcgtatctcacccaccggcgaactcgaggtgaaaggccagaacgtgttccttggctaccataacctgcccgagaagacaaccgagacctttgccgaggacggctggctcaagaccggcgatctggcttcgattgacgacgaggggcatatcacattgaccggtcgtgccaaagacatcatcatcaccgccggcggcaagaacgtctcccccatcccgatggaacaggagatctcgacctgcccaatcgtcgagcacgccgtagtggtgggtgacaatcgcccgttcgtcggcgccgtgatcacattggatcaggaaggactcgccagctggctgcccacccagaaactccccgccgacctcaccatcgaacaggctgctggtctgcctgaagtcgccgccgagattcagaaatatgtcgaccgcgccaacacgaacgtctcacgagccgaatcggtacgaaaattcatcgtgctgcccaccacgttctcgcaggataacaagtgcttgacgccatcgatgaaggtcgtacggccgaaggtgaaccaggtgttcaaggaacagatcgacaaccagctgtacgtgggcaagcgataatctcgactctttcccgtgtatatggcaatgggctgcacctgcgcaggtgcagcccattgccatatacacgcgaattatctgcccttgtatgtggaggcaatctcattcaaccgcttctcgaagcgcggccagtcagctcgcattgcggtgagcagcttcaggttgggcacctcggcaatcggtacccactcgatctccatactctcatcgtcattggcgcgcggatacacctcatggcccggcttctcgaacgcgaacaccgtggtgtatgcccatgggccgtggtcctcgcaatatgagcccaccacttcgatatcggcaggagtgatgttcgcctcctcgtatgcctcgcgaagcgcaccctcaatcgggctctcgccatcggcaatcgcaccgccaggaataccccatgtaccaccctcggcactccaagtcgcgcgatgctgcatgacgatatgcgtcacctcgccggtttcctgatcacgacgggcaagcaacacaccggctgcaccattggtaccccaatgcttacgcccgcatgcacaatccacccaaccgtcaccaggctgatgcacattctccttcggaggcaatgccttgaccgacgacagcggctgagggaattgttcatcacgcgccacgttccacaggtcggtccaatcgatgccgagttcctgcacgagctcacgggcgagtggcagactcaaaccaatgatgccgctcggatctccctctatgctgtcgatgtaggcgccgccaaatccgtcaagggtgaaggagcctgccacctcgagcggctcccccgtcgcaatatagcggtcgatcatcaaatccgagaattccgcgaaatgaatcaccgcgcggctcacaccagtcaccatgcgaccactggcgaaatcgatcaggcaatggccagtgaacagttcgccgctcgcaccactcatcagttcaagccgttcgcgcgcaatctgttcggtatgtggtttgccatacgctttgccgtcgagcaggaacatcgaatcgcagccgagaatcagcgggccgactttcgcattcgtcaacccgtgcgtttcaacaacagtgtcttggatcggctgtgttcgagtggggaactgcacgcccgagaaatcacgagtctgggcgtcatccgtatgagcggaatctgcagtcgactgcgcagcctccaatgggaatccggtcacctcgtcaccatgagcattcgtggatacctctgcgacatctttgtaggcctggtataccgcgttcgccttcgcttgggcaagcaccatgaccttcgtggcgatcggcaaatcgtcaacactcacaccggcacccacagcggccttcgcaatcaccccgggttcgtccacatgcgagacgcgaatggtggggcaaatgccggcatggaacaacagatcacggcgcggtttggacttcgaagcgagaatcagcggaatactcatactcccaccataacgcacacacatggcacaatgcctgtgaaattcatttgaaaatcgttaacggcgcgcatattcgtagccagcgcgctctattatgatgctattgattgaatgattgaatggactgcggtgaatacccagtgatgcgtacaccgcaacccggagagcaacgagaaaggcatacgcgatgaaggtgctgtttgtatgcacgggcaatatctgccgctcacccatgggcgaactgttgttcccgcatttcttccatacgaatggcatcgaaaccgacagcgcaggaacacaggggctcgtcgacagcccaatcgacccatcgagcgcgaaactcatggcactcgacggcatcgattcgagccaattccgttcgaagcggctcacgccccaattggcgatgtcgagtgatttgattctatgcttcaccgaacatcagcgccgaaagattgtcgcacttgcaccgcgcgtgcggtcgaagaccttcctgctcagcgatttcgccaacctgtgccggtacttcgggcagaacaatctgctgcatggctccaatgttgaggaccgcatgcgtgaggtgatgtgcaacgcatcgatggcacggcgagcactgccggaggcggaagatatcgcagacccctaccgcaaggagtttgcggcgttccaagtggcgcacgatcagattggatatgcgatcgcggatatcgcgcaggcgttggagccttcacgtgcggggcatgcgactgaataagacagctgtctatgccgattccaataactaacgaaatggccggagctttcgtggctccggtcatttcctgttcagatcatcgtgtcagtttgcttttgctgagcacttcggctctttgacggtgatacccgtgtctttccatcccaatggtgtctgatcaatggtcagtgcagattgtgcctgtggggataccgtgacatcaaaggagtacgtcacactttgctccggcagaatctccacgacggtcttatacagctccttgccgttcatggttgtcttttgcacggcattcaccgctccgttaagttggctgatgttgttgatgcgaccgccggcaggagggtagaacagaatcttctcgatacctttgcccctatttggcgcatcaacaccggtgatatatggcggtagatttgccacgtcgctcaccttcatcgtgttgttgagcgtgtattcaacgtgatatgttgcaccactggcatcgcagcgggttttctcgatggtggcggtacgcttgatataccagcccatcttcgacggattctgctcggtcaggtagattccaaccgaaggattctgcggatcatttggcgtctcaccggtgaatcctgcagcttggatttccttctcaaggttcgcatcgaaggagaacatcgtgaaatggcgctcccgagccatcgtgcccatagtttcgccgattttaacgagtttgccgagattcaggctcttgaacatgccagctatgacgtttcctgtggtttccccgaacacagcgtctgtctgtgatgcttcgtattgtttatacaccgtattgaggaagtactctgcagtattgtcaccattcagagtcgtcccatctgcgagcgtgaccggcccgttgatcgccaccatttcctgaacgaacaccgggtcgaccatgattacaccgctcaacggcttttgctgtccccatggagtacgattccaaatcgattgcatggccagagcagctcgttcagtgtcagggaaaaccgccgtgtcacggatatcgaatgacatgtgaagaggaccctcatccgagaaaacacgcgccatatcggcagagtgatcaccaatgccatacggcaaataatccttattcgccttgaattcaccaacgtgaacactgccattgtcagcggtgagctcacccacagaaccaatgagaccaccagatgaacgcatttcggaagtggtcattgacatcacagcataggtgcgggtttgaccattgcccaggaatccgggaagcatgcggaacgtgctagacaacgcatcaacacgggtggccagcgcgttcaatttgtccgagccttgggcataagccgaacgaacgatatcaatattgggctgcggtagtgcattgtatgcacccacttggtgttgtaaggattcattggctttctgcatgccttgctggcagtcgatgattggtcgaagattgatgccatcgtcagttgaggagagattcgcatgctgcaggttagtaacgacatccatgaattgcggcaccgattgatgcattaaatcatcgatcacgttggtcataccttgcacggtagagacattactaccgaaataaggaatcttattggctatattccaccaagcaccattggcgatggcagaggcttggctggtctcttgctgaatctgcgggagctggtctttgaccttctgcacattggcatcgtctatcttcgtagagaagtcagagatcatagacaacgcccgactctcatgcgcctgcacctccttcgactgcctatatacattgaaccccgcgattccaaatagaacaagaactgcgacaaacagaccgacaatactcaacacccaaggccatacgcgatgatgcctcttgacattagtccgtgatactcgatgcgatgccatacgcgcccccgacaatgataagcaccgcacgccaaaaggcacgcggtgctatgttatacattattttacgatttacgattttttctatttttttcagcaggactactattcgaataatagtaatagttactattctcaagtgccttcttattttccttagcgcagttgataatgactcccgtgacaggcatgtccagagtctccagttcatctgcgatctcgtgcagatcacgcttgagcgtctgatctcggcggcacaccatctccaacgtgccaccctgcttcatgaagatcacggcatcgttcgccacgaccattggagcggtgtcgatgatgatgtaatcatactgctgcatcgcattggccaccaaagtagtcatcagaggagagttcagcaacgtcgacgcgttcggtggcttcgggccagccggtatgatgtgcagattcggcttccagtagcgctgaatcacatctttgactgccgcttggccagaaagcacatgggtcaagccagcagagccatcgatatcgatcttatgcgcgacggaggggtgacgtagatccgcatcaatgagtaatacgcgtggaccatcctcagcgagagcggcggcgatgttcaccgaaatggtggttttgccttcggaagcacctgccgatgtaacaaccacaagacggcagttcgtaccttccaccggagtggagaacgaaagattggtgcggatacggcggaagtcttcagcaatcggactccctggctcactgactacaaccggagaactgccagcaagaatatcatccttcaccacgcgaccgattatcggcgcgtcgacaatatccgttacatcactctcgtcctggattttcttggaaagcacatccttcagcaatgccgccaatatgccaataatcaaaccacctagcacgccgaccagaatgttgagactccacttcggggagctctgcttcgtgggaacctgagccggctgcacaatggaaagcttcactgcggaattggacccggcagtgtacagggatttctctacaacattgctgagcgaggcagccacaccgtttgcgatgcgggcggcggtcgaaggatcggcatcagttacagcgatattcacaaatgctgtgttcgtaggattcgttacggtaatctgcgacgcaagtgagataggcgttgtatccaatttaagctcgtccacaaccggctgcaataccgattgtgttttcgccaaatcagggtacgacttaatctgactcatgatatatgaactgccgctgtactgctcagaggagttcgcggaatcattggaactgttatacgtcgcaaacagctgcgtggtggtcgtatacgccaccggagacatagctgtatagagtatatccacaccaagtatcaccacaaaggtgacggcaatcgtaatgatatgtttgcgcaaaatactcagtaaatcgacaatggtcatgccttcatgcgcaggcactggagtttgcgattgactctgcgagtagcggtttacctcgttctcggccatgtataacgctttccattcaagcatagaggcaccgctcaagtcagaactatctctaggctttcgcttcaacctcaacgtttcccatcgaatatcaacttttatatgatatcaatcgtttgcgactgcgaaacattgtgcggattccccgcaaaaatcaccaagcatcttcacatctttgtggcgcagaagaacactctctgtgaggagtttccgggaatcgcaccaaagtgcggtagcgatggtgccaatgcacgattacagtcattcccaatcgaatatcctgtagagaaagagaaatccctctgccagtatggcgctatgctctgggaacgtctgacattatgagcaacgtgcggatactgaacgtgccttggtatttgttctggaatagctattcggcgcgggttgagatcaaagatgcggagtctacagcggatatcttgtagtgcgcaattggagagttcggtctcactgcgaccatgtaggcgaggtaaatgtgccgtgtttgcaaacagcctgccgcaaagatcatcgagtgagctccaacatcgccgttgccgagagtgcagcctcataacagcaaccgaagcgccgccagggtggtcggtcttgcaagcccagtctcaaggaggcgcttacagcaccgacaaaagcgccaatatagagaacggtatctcaaacaggcaatttaggcgcgccaacttcatttccacaaacacttcatgctgtttcgtttaccacgcgagcagttttggggccatgcgggagaatcgggaatcctctgcgattccagcggtagaattggaaccgtaatcttgagaaggttccagcagctggagtaatctgcgacgacgatgtcgcggacccgcaacgaagcgaggtgctgtcatgttcaacggcaagaagaaagcgccaaagaacgactggcgacagtcaatcatgtcgctcggccaagtcaagaatgaggcgaacgagagcgagagccagacgacaaggcgtatgccattcggccgaaccgggcgaacggatcggccacaatctcaacacatgccgacagcaaccatgcccaatggtccggccacgggcatgcaagtcgccgcacaagccgctcccccgcagaaacgcaaacgattcaaggtgctgatctacgcgtttgccttcctcatggtgtttgcactcggcgtgggagcgggttcctcgaatgcttcgaaaccggcgggaacggtcccgtctgctgcagtcgcgcccaccgagcagatcgacgccaaggagaacgacgccgaattgaaacggcgagaggaggctctgaacaagcaagccgaggaactcgacaaactgaagcgtgagctcgacgagcagcagaagtcacaaagcgagcgccagacccaactcgacgagcgagagaagagcatcgccagcaaggaggaggcgaagaaacaggcggaggtcgaggctgcacagcgcaagaaggccgagcaggagcaggcggccgcagcggagaaggcgcgcgcggaggccgaagccgcggaacgggagcgggcacaggctcaggcggcacaagcagcggcggaggaagcggctcggcagcaagagcaggctccgcaggtcgtagaacagcagacatcgcgaatagtgcatccaggtgccttctgctccacagccggggagacaggcgtttcgcagaagggcgtcggatacacgtgcaaggcagataacagcgggcgcttgcgttggcggcggtgatggggtgtgcggcggtaatatatcgcagatcgtcgtaaaccgaatcgcatgcacaatgaagtgttccgtcgattgccggattttggaatgagaaccgtgctttcaaattgagtatccagattagtaccgcgtgccctcggaagagagcatcgccgcactcgtccaagccaatcacacaatcattgttttgtatataccatttgccgagcagctcgttgagcatgatgcaatcttggtcttgtgcggacacaagcgaaagccacagcaggcgaacttaaagtgccatgcttgcaatcggttggccgcaatggtcatcgagcaagctctagcattgccgtcgccgcaagcgcagtctcataacgacaaccaaggcactgctaggaagatcggtcttgcagacgcaatctcagcaaaagcccttgcagtattcgccagatcgtcgatattgcgaacactatctcggtgaagcactcatatgccatcgttcgaaatatacacagagatactaccgaacgttgagattatgtaatttcgatcctccatcggtgccgttggcgcgcacagttagcgacacggcgtgtgggtccgcgacgcgtagtggagggaggattcatatctgcgtggtgcgatgcgccagatttacaatctggtccggtcatctctgctgcggacagccaccgaatccatggtctgcaaatacgtgctatggtttgtgatggcatgcgttccggttgccgcccccctttggtagcttctgagacgcatgcctcattcagatgagagcctgctcttcgtcgcaggtatagtggctcttctcaagttagtgtgtaagggccgtgcttcatcattgcttgtgtgatagagaaattgaatgaggaaacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgctggtgcgcgtgcgccgctacgagtgcgtgccgtgctcacgctcgtggagcgatgatcttgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccaaggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatccaacgatgcctcatccacagcagccaactcaaagacatccttacacactaacctgagaagagcccctaaatcatggatgcccgcaaggaacacagtgacccttttcgctagtgtggcatccccattgaaattactcgcaatgatttcccgggtaccctccggcaaccactcatcccagattttctcggccacaagagccgaatccgacatatgcacatacaacggaagccactcctcccccacatcccgatcggtctttccccacagagcgcgcgcttgcgccgacagagccaatccatcatccgaagaatatccaagctgccccatctgaaaccccctgcgctttcacccttgatcgcattgtttcacccacactaccatctcaagcgcgttgcgaacaacaacatggagagtcactctccaagcattttataaacacatgcacaagccggtggcatgatcgggaacatacattctacaaatctgtaaaaaagacagatacaaccttaatctgtccctttttacgtaatagattcaatgaattcgatagctccttgcgtaaaaggagacaccatcagcggcttacccgtcccgaacgcaaaagaggctggagctacagccgcgccacctgcacaccctgcgtgtccacgttgaggtggagcacacgccagtggccggatgcgagctgggcggtggcaatctggttcaggtcgtccgaggcgtcgccgttgtgcagcacgcaaacgcatgggccggcacccgatacggcggccgcatacccgtgctcgcgcagcaaatcgatgagttcggcggacggcttcatgagcggcgcgcgatagctctggtggagcttgtcttgcgtggcggtgaacagcagttcgttcgggtcctgctcccctgccaacgcggacggattcatggctccgatcagcagtcccatgcgagacacgttgaacacggcgtccgcgaacggcacggtgttcagcaatgcggcgcgggcctgcgcggtggagagttcgtaatccggaacgaaaatcgaggcgcgcacgccggcgtcgacgaggtagttcaccgagcggaagccggtgttcaccacctcgccctgcacgatctcgctttgcccgtcctcggtccacgagacggtcatgccgccgtataccgcgggcgccacgttgtcgggatgcccttcgaggtcggccgcgtactggaagatcacgtcgcggtcgagctcgccctcgtgcgagaacgcgtaggcggcggagatgccggccacgatcgcctcggcggacgagcccatgccgcgcgcctgcgggatgttgttgtgcgcctccatgatgaacccgcatttgctcaggccaaagcgcgaacatgcgcggcggaacgtggagaccaccaggtgagactcgtcgcgcggcagcgtgttctcgccttcgccggtgatgagaatctgtgccgccatgttgagcggatcggaactgagcgtgaactcgagctcgtcatggtaatccaaggcaagtcccacggtgtcgaaaccggagccgagattggcgctggtcgccggcacgcgaacgtggactttacgagtcaccggatccattttccacttcctactctgacggtcagggcaatacgaattgccggtctatgtataacagattatcagtcgagcacgcgaatgatcgatgggtcgccggtcaccgagtcaagctggcacaccgcgtcgaccgcctcgcgcagcgtcgtctcgtcggtcatatgcgtgaccaggcgcagctgctggatctcgccgtcatagcccggttcggtcgccgtgggcttgaggtcctggttcacgccgttgatcgagatgccgcggtctgcgaactccttcgccacctgcaacagcacgcccggcttgtcgtgaatgaggaagcgcacggcgaagctcgccttggctgagctgagcggcgcgatcgggtagtcgttgtacatgcggatcgccggaccggtgcaaccggaggcgatgtggcgcgcgacggtgacgatgtcgccgacgactgcggaagcggtgggggcgccgccggcaccgcggccatagaacatgaggtcatcggcatactcggcgtgcaggaagaccgcgttgaaggagccatgcaccgacgccagcgggtgctcgttgcgaatgagcgcagggtaaacgcgtgcggagacgccgtcttcggtgtgatcgaccacggcgagcagcttcaccaccttgccttccgcggtggcggcggcaatgtcgtcggcggtgatgtgcgtgatgccttccacggtcacgtcgtcgatgccgacgttcgtgtggaagccgagcgtggccatgatcgccgccttgttcgcggcatcgtagccttcgatgtcaccggtcgggtcggcctcggcatagcccttctcctgggcctccttgagtgcgacgtcgaaatcgaggcccttggtggtcatctcgtcgagaatgtagttcgtcgtgccgttgacaatgccgagcatgctcttcacctgatctccgacgagcgactcgcgcagcgggcgcacgatcgggatcgcgccgccgaccgccgcctcgaagtagatatccgcatggttgtcttcggccgccttatacagttccgggccgtacttcgcgagcagcgccttgttcgcggtgaccacagacgcgccgttgttgagcgcctccaacacgaaggtgcgcgcgacgccggtgccgccgatgagctcgaccacaatgtccgcgttcttcaccaccgacatcgtgtcgctggtgagcagcgacttgtcgatccacgggaagtccacctcgttcgggtccaggcaggcgatgccggagatttcgaggggacggccaatgcgctgcccgagctcgtccttctgctcgaccaggatgcgcgccgtctgcgagccaacggtgccggctccaagtaagcctacgcggatcggggcgttctgttctgccatgggaatcctttcatgcggtgcacactgcgtgttcacaggtttgcttaggtcattgtacgtggaggtgtatagccgcgtacgcagtcgctctgtctgtggaatcgaaatccgccgctctttgcgtgatctacgtaaaagtggacagaaaacgcctggatctgtcccaaattacgcaagagggagacctgcacggaggaagggaatctacgtaaaaggggacagatcaccgggcggaattgtccccgattacgcaggtggcaggtgtttgccattcactcgctcacgtcgagcgcgagcaggtcgtcgatcgtctgccgacgcatcatcacatgcgcgccatgcccgtctatgccgacgacggccggaatgagcgccatgttgtagttgctcgccatcgaacggccgtaggcgccggtgaccggcacggccaggatgtcgccgcggtgcacgtcggcaggaagattcgcctcattcaccacaatgtcgccggactcgcagtggatgccgacgacgcgcgagagcttcgccggttcagcggactcgcggttggcaagaatcgcggtgtatttcgcgtcgtagagcgcggggcgaatgttgtcgctcatgccgccgtccaccgagatgtatgcgcgttcgcgaatccgctcgcccgcgttgttcgtgaagccgtcgccaagctgcacggtcttcacggtgcccacacggtagagcgtcacgccggcgggggcgacgatccagcggcccggctcgaacgagatgatcggcgcgggcatgccgagcaagcggttcgtcttcgacacggcgtcggcaagacggccgagttcgcggtccacgtccatgcggtcctcatcgtcggtgtaggcgaccgaatagccgccgccgagatcgacctcggggagcgtgtaggcattcgtcgcatagaacgtcttgcgcagcagcatcatgcgcttggccgcctgaatgaacgcctcggcatcgtgaatattcgagccgatatgcgagtgcacgcccacgagttccagattgccgtacttggcgatctcacgcagcacggcgatggccggaccgttggccacgagctccatcgcggcggcaagcaggcgatcaccctcggtcacgtcggcggcgttcagatcgtacgggtagcgcacgtcgtaccgcagctgcctgtctgcctgctgcttcgtctcgccgccccgctcgagctcggtctcgtgcacgagcgcgttcgtggccgccggggagacgtcctgcagctggtcgatgttgtcgacgatctcggtgtcggcacctgcaggcagcagtgcgacgccgaatttctggtcctcgtgcgcggtggagacgtattcgtggccgccggcgtgaatgccggaggtcacgcgcagcatcacgcgggcgcgcttgccgagccgttccgcaatcgcggcgatgcgtgcgggctcgtccggcgaatcgatcacgattttcgagaagccctcggcaatggcgagttcgatctcctcatcgctcttgttgttgccgtgcagcaccagtcgacgaccgggaacgccggcggcgagcgcgatcttcatctcgccgagcgtgcaggtgtcgacgaacatgccttcctcggtcacaatgcgcgccatttccttcgagaggaacgccttggcggcatagctcacatgcgtggtgttgttcgtgaacgcgtgtgcggcggccttcacgaagtggctggcgcgggcacgcacctcgtcgagatccagcacgtacaggggcgagccgaattcgtcgagcagggtgctggcggtgatgccgtggaacgtgagctcgccgttggaattcctggccgtgtctgccggccagattggactgatggccatattcatctcctcatctcgtttgcggtatcttcttcgttccgtcccccgctcttcccctctcccccctttgcgtaaaaagagacatccgctggctcgaatacgtctctttttacacaagggcaacaaagcactaagtccacaaaggaagagaaggcggagaggaggccaggaggaccgcacgccggaaagcggacttacatcttgtcgggggcggtcacgcctagcaggtcgaggccttcggcgatcacggtctgcacggcgtcgttgagcttcagtcgggcggccgcgcgcgcgggctccgggttcttcgcgatgcgggtgcgttcgcgggtctgctcatcggcgcgctcctccgcttcggtgagcggcatcggcaccacgcgctcgacgttgtaccacttgtggtatgcggcggcgaggtcttccaggtagtgcgcgatgcgatgcggcgcgcgcaggtcaccagcgagcgtgagcagtgcgggccactgcgcgagtgcggcgatcacctcgccgtccgcctcagtgtcgagcagcgagagatcggcgtcggcggcattgatttgcgcggcttcggcattgcggtcgacgttgcacgagcgggcgtgcgcatactgcacatagtacaccggattgtcgttcgaatgcgaggcgagcagattgaggtcgatgtcgaccggcgaattgtagtcggtgcgggccagtgaatagcgggatgcgtccacgccaatcgcgtcgatgaggtcgtcgatcgtcacgatgttgcccgcgcgcttgctcatgcgcaccggcttgccgtccttcatcacattgaccatctggccgatgagaatctgcatgttctcgcccggtttgtctccgaacgcggcgcacatggccatcatgcggccgatgtacccgtggtggtcggcgccgagcatgtagatcgcgacgtcggccgggtcggtcttgcggtggcgcttgttgcggtagtaggcgatgtccgcggcgaagtatgcgtacgtgccgtcggatttgatgatcacgcggtctttgtcgtcgccatgctcggtcgattcgaaccaggtcgcgccgtctttctcgtagatgtcgccggcattgcgcaggtcggcgatcgccttctccacctcgccgtcctcgtacaggctgttctcgtggaaccacacatcgaagtgcacgcggaattccttcatggactggcgaatctcgtcgaacatcattggcaccgcgcgcttgcggaactcctcacgctgctcggaatcgccttcgcccagcggctcgcccttctcgtcggtgccgccgtcgacgcgcggcagattgagaatatcgatgccttcggcgttggcctccacgatcacacggcgtgcgatctcgtcgatgtaggcgcccttgtatccgtcgacgggcgtcggctcgtcgtgggcggcggccacgagcgacttggcgaagcggttgatctgctcgccgtggtcattgaagtagtattcgcgcacaacggtggcgccattggcctgcagtatgcgggccatcgaatcgcccaccgcggcccagcgcgtgccgccgatgtggatcgggccggtcgggttcgcggagacgaattccagattgagcgtcttgccgctcaggtgattgttcttgccgaatcgattgccctcgtcgagcacctggtccaccactgcggccgccgatgcggagtcgagcgtgatgttgatgaagccgggacctgccacttcgacggcggcaatgccatcggtgccattcagtgcgtcggcgaacagttgggcgagatcacgcggtttcatgccggctttcttcgccagctgcatggcggcgttcgacgcccagtcgccgtgcgcgcgatccttggggcgcatgacggcgaatttggcggaatccgggagttcctcggccgtcaaagtgccggctttaccctcggaaacaaggttattggcaatggtgaagatcaattcctgtagcgcttctggactcattccaacaagtctaccggcaacgccgacagatttgaggaatatcctcgattgtgaggtggcccgtcgtccgcatcttcgattgttaggttgagtaccctaggagaacatcatgaaaacccccttttattcgacaaatcacccaacttttgtcgaataaaagggatggaattatgcgtggatactctggccacccacctaacaatcgaagatacctgaagacgatcaccacacggtacacatcatgccaggaaagaggtgagggaggaagccggcaatgtcagcatcacgccgttgcctgcaccgcgcagatggcacagcaggtcgagcggctcggggcgagagttcacgagcacggcaacaacctggtcaccatcaccatgagtaagagcggcagggactaggaaggcggcggcacgcacaccttgcgcatggtcgagcgcgcattccacgcaacgtgagccaatcggcacgtatttggagaagtggccgagcgcgtagtagtctgcattgcggcgtatcgaaccgtcgtcacgcacagtgatcagaccacggttctcggaatgccggcgatcgttgcgcaggtagtagtagtcgggaccgccgtgctcgtcgagcgcgatgttccacaacacggcgctcctcgcccagttgttcatcatgtcaatgaccgccgtgcccagcgagagcagcgcgggtgtgaaattgcgcggcccccagtcgccgccgctcgcctcggtcgcccagatgcccttgttcggaaacgcgtcgtgaatgcgagacatcgtgcgcgcggatccgccgtaataatgccatgcggagccggcgcaggcggtgagcgcggcggaatcggcgtacatgtctcgcacgaaggcgccgtccggataatggtcggtggagtagttgtggtcccagcacagaatgcgcgtgccttccaatccggcgtggtcgagcatggggcgcagatggcgcgcgacgaactctgcctgctcgcgcggggtcattgccatcgatggccatcgcgactgcgggtagtcgggttcgttcgtcacggtgagcgcgaacagcggcagtccgcgctgcgcatacaatcgcgcaaaaccggtgatatagcgcgcataggcggcatacatgccgcgccgcagatggccggtgatccgcgtgtagcgccgtttgccgagcacgctgagattcgttttcatccaccatggcgcgctccacgggctcgccataatgttgagcgcatgcgattgcgtggcgagcgcacagtcgttcgcggcctcgaccatgggcaacacgcgctccatctcgggtgtgaaatcgagggagttgagattgcggtcggggaatctgcgcacgaagcggtacggcgcgctcacatggtcgcttgggccgattggctgacggagcatcgagatgcctatgccgtcgcgcgggctgaacagatcgcggatgcatcgctctttgtctgtgacgcgattgtgccacagccagctcgtcgcctcggtgatcgatgcgccgaagccgtcgatgggctggcgcacgcgagtcgtgtcgatgctgagcgtgggggtgctggcgtgtgacgtgctctccggcgtgcgccctacacgcaaataggcattcccaagcggcgcgaacgcggcggcaagcgtggtgccctgcgcattcgcgtatgttgagaatgcctgaatcatagccccagtctagcgctgtgcgaaacggcatgcgcagccgtgcgccgacggcggggcgaatgtggcgtcagttctgcgggcagaccgctatgacgtcgatctcgacgagcgcccccttggggatcatgttgttgccgaacgccactcgtgcgggcttgaccgtgccggtgaaggtcttcgcatagacgccgtccacctcggagaaatcctcgacgttgcgcaggtagatcgtcgctcggcagacgtgttcgacgccgcatcccgcggcggcgaggatgttggtgatgttcttgagcgcgcgtgcggcctgttccgccgcggtgacgccgtcgagctcgccggtggccgggtcgatgccgagctggccggagacgaacacgaatccgttcgccttgacggcctggctgtatgcgccgagtgcggccggcgcctccatggtggtcactgcctgcagattctcgtacatgatgttcctttcgctcgctggcgtgaatctatgctctggtttagcaccttgagtgtgcacgtgggctcatgtttcatattgcagactactcgtggcagcccagaccgctgccccaccacgctacgcgaatgtttcacgtgaaagattggggaaccacgcatcttcgatgttctgcggattgcggatatggaagaggccgaggtacagagacaatctgcaccccggccgaatgagaggagggaacgaatcagcccttcacggcaccggccatgatgccggagaccagttgcttgccggcgaagaagaacagcagcaacagcggggcggtggtgagcacgacgcccgacatcacgatcgtgtagtcggtgaagtatgcacccttgagcgttgcggccgccacggtgagcatcttgttcttgttcgggccgagaatgagcatgggccagaagtagttggtccactgggcaatgaaggtgaagaggaacagcatcgcggccgccgggcgtgcggcggggatggccacatgcaggaaggtgcggaacatggagcacccgtccacgcgagcggcctcgatgagttcgtagggcagtgcgtcgccgatgtactgggtcatccagaacacgccgaatgcgctgaccagtccggggatgatcacggcccacagcgagccgaacaggccggctttgttggccatgatgtacagcgggacgacgctgagctgctgcgggatcgtcatcgtggcgacgacgagcatgagcagcgcgttacggccgcggaagcgcagtttcgagaacgagtagccggcgagcgtcgagaagaacacggtggagatcgaaacgatggtggccaccaggaaggtgccgccgagcgcctcccagaacttcatggcaccgaaggcgcgggcgatgttcctgaacaagccggtgcccggaatcatcgccggcatgttcgtgctgtacggcgagcagtatgcgcagattctcgagcaattcggcgaggcctgcggcatgggcgccgacgaggtggcgaacgagaccgccgaggtgcgcaagacgatcgccgaagtgcgtgaggccacgctcaccgctggttgggacggcgcctggttccgcagggcctacgacgccaacggcaatccggtgggcacgaatgaagacagtgaaggcaagatctacatcgaaccgcagggcatgtgcgtgatggccggcatcggcgtcgacgacggcaaggcggccaaggcgctcgaatcgacgaaggaactgctcacctgccgctggggcaccgcgatcctcgcacccgcatactccacctaccgcatcgagttgggcgagatttcctcatacccgcgcggctataaggagaacggcggcatcttttgccacaacaacccgtggatctccattgcgaacgccaagattaacaacaacgacgaggccttcaacgtgtacaagcgcacctgccccgcctacaccgaggagtattccgagattcaccgcaccgagccgtacgtgtactgccagatggtcgccggccccgaggcgccgaccccgggcgagggcaagaacagctggctcaccggcaccgcggcatggaccttcgtagacgtctcccagcatctgctcggcgtgcagcccacattcgacggcctgaagatcgagccgcacctgccgcccaacttcggcgagctgcatatcgagcgcacatggcgtggcacacggtacatcattgacgtcacccgcaccggcgaacagtcgctcaccgtggacggccagccggtctccggcaccgttgttccaaccgcagcaacaggaaccgaggaggtgcatgtagctctgacaatctgactgattttttcttcttccacttccgcgaggtctgcagggcgccatccctgcggacctcgtttgcaatcctggtggccgaaatccgggtggacgattgcgcgcccacggcacgagccaaaacgaagaagtctggaataccggcatttcggtattccagacttctcaacatggtgggctcaatgggattcgaacccacggcctttcgctccggaggcgaacgctctatccactgagctatgagcccatgcctgcactactttacacgttcgcctgactttccgccagcaggcgcgtatgtaatgcggacaccgaatggcggtcgcgatacgaccgatcagtacatgagcgtggccaggcggcgacgtgcacgtgcgagacgctcgtcggtggcctcgggaatgaggaagtactcgagcatgcgttcgcgaatcggctccaccgcatccggatgagctgccagatagtcgagcagacggtcgaaggcatcctgaatctggccgccgatcatatcgacgtcggcgacggccagctgcgcgtcgaggtcgtccggatttgccgcggccttctcgcgtgcctcgcgcacatccgcattcgcggaacgggcaagcagcagcgccttcgcacgcccgcgcttggcgagttcgtcgtccggctcacgttcgagcacctgctcgtaggcatcggcagcgcccgcatagtcgccctcctgagccaaacggtgtgcttcggcgtgctcaggcggcacggcgggttccttctgcgtgtcttcctcgtcgtcggcgttctgcggcgtgatgtacggcgcggtaccggtcacaccggcctgcgccgcgacctgcacgagctgcgggagcacctgcgtggtgatctgcgtcatttcgtcaccttgcggcatgccctgcagaatcggcatcgggcggccgccgatcagagcgaacaacgcgggcgctccctgcacgccgaatgcctgcgcgatctcgggttcgcggctcacgtcgatgcgcgcgagctgcagcttgccgtccatgccgttgaccgcgtcgccgagttcgcgggccatgtcgaacaggcgattgtcggtaggcacccacatgaagatgacaatcgggtaggtcgccgacgcctgcgccacggcctggaaattgttctgtgtcacatcgatcacatagccacccgcggccggtgcgccacctgcttgccccggctccgccttgacctgatgcttgagtccctcgaggtcgatggcccctgccaatgagattcccggcttgatttcacgttccggcatgatgcccctttccgcgcgtgttcgcgcactgttgaacgtttgcaatatgcgcgtgcaaaaagactgttagatcgcctcgaccttgaccggctggcgttccgcgcccaccgccgtgatcttcgcgttcgccttggccgacggtatgtagagggcgaccacgttcacataggtgacgcgcatcgtgctcgtggccttcgcgtcgccgaacaatgccttctcggaatccgaggccggctgggactcgcgtccctcgcccgctgcgcgcgtccacaccgagttgatctgcgccaccaccagatcgccgccgtcagccgcacgcataatgcgcatctggccgtccaccggctcgaaggtctgcgtttgcgtgcccttgttgcgctccatgccctgttgcacggtctgcgagagcgtggcgagctcctgccgcaggtaatcgttgtcgaaatcgcctgcatactggctcttgtcgccgttctgcagcacgtccgcgtaacgcttcaccgcttccttcggcgtcatcttgagattgtcgtcgttgtcggtgcccatctgcgcgccgatctgcggcacggtgaacttcggcatctgcacgccttggaacaggcgcgcgactccccacagcttgtaattctgccgtgcgctttcctgatcgaacacgagcaggcgcttcgactgctggtcctgcgtggtcgtggtgatcgtgaacacgctgcgcggccatccgctatcggtcgggatgatcgtctgtgtgatcgcatcgggaatgtcggtcttcggatcgagattgccggtcttctgcgccacggcgagctcgcttctgcgaatctcgagttccgggcccgacatcgcacggtcgaggccgtccgccgacttcgcattgttgcattgctcaatggcttcgagcagctgcttgcgtatcgccttctcctgctcggtggtgagattcggtgacgccgaagccgaggcggtcgcctgcaccggttccggcaattgcccttcgcatgcgccaagcgtcacgcacatgcacaacgcaaggccggctgcacccagagaaacggctttcctacgcgtgttcatttgccctccttgtcgcccgactcggcggccgcggactgctccccttcggtttcttcctgagaggcttccccgccctcgctcgtctcggtgacgtcttcgggttccgtggattcagtggattcattggattctgcagactgttcgtcttcggaggattcagattcgtcagtgtcctgcacacgctcggcctctggctcgccctgctcggacggcgtggacgattccatgccgacttcgcgggccagacgtgcgaagtagtcctgcagctcggcttcggtgatcaccgaagtggtggtgccatcggtggcagacccgtcattggagaccgtccgcgtggccgtttcgctcgcctcatcggagccattcgccacggagacctccacgctggcgttctcgttcgcctgctgtgcctgttccgccaccagatttcgtgcgtgcgggtccacgatggtcggggttgtcggctgctcatcctcctgcttgccggcatgcctgccgtgacgaggaccacccttggtcttggacttgcccttgctccgcggtttcagcgccgcgagggagcctgcaagcgcctcgcctatcttcggttcgtccttgcgctgttcctgccgctcctgacgggcacgttcggcgtcttcgctcactttcttgcggcgcgcgctcatgtccatggcgaacaccgaggcgcacagcacggcgagcaccgcacacagtccgcccgcgaaataccacgggatggagaagttcggaatgtcatgacgggtccaatgcatctcaagcgagccatcggaaaccttctgaccgaagtccgcaagcaccacatcggtgccggccgcgtccttgaggtcgagggatgccttgccggcaccgcagttgacctctttccacatattcgagtccttgaaggcgacgtcggcgccggaggtgttcgcctcgccttgtgcaccctgttcggcgtaagacagtgtggaccaattggaaagcccggtgatgcgctcgtatggctgccccgccagccagccagccgcatccttgggcgacgtgagtgccatgcatacgccgtcgttggcggtggcgctcgggcttgcggcttcaattcgaacgttcttgtcgaccagattggccacgccttggtcgacgagcaggtattgcgtgttccgtaccggcgcggtcgcggcaatctgcggattcggctgccagatggtctggttgagaataccgaaaacgatgcaggcgaccgccaggaggccaaagatcggcgtcaccacgccgcgcatgattttcgcgtggcgcgtcggctctttcttggtgcgagtctgctctcgctgttcgtgtatgtctgtcatatctcttctattctagcgctgtatgcagattcagcttcttgcctgagcgcatatacattcggcgaaatacatgcgcgcggatattcttggcaggtatgacacaagccaaatcagcaggaatccgcaaacgggcggtgcaagccgtggccgcgatgtgcgtggccgcgacatgttttgcgttcgccgcctgcggaaatagcaatgcatccgaatccaccggaaaatcttccgcctcttcctccgccagctcgggcctgacgaagatcgagggcgtgaaggacaccgcgaaggtgggcgagaagccggtcctcgaattcaagaagccgctcaatgttcctgataattcctatgccatcttgcaggaaggagacggcgaggtaatcaagccaggcaaccgcgtatgtgcacagggaatggccgtggacggtaaaacgggcgatatcaagatgagcacttgggagaccaaccagatggattgctcactagtggcgcctaaaaaaggtgaaaaaacatctgcgttgctgtcggtgattgatggcctcaagcttaactccaccgtggtattcggcagcaatgacagcaccgccgactcatccaatctcatagtgatgacactcaagtcgcagtccactgacctcacgaaggccgagggcacgaaggtgaaggacattccgtcggatctgccgaaggtgacgaatgcagccgacggcaagccctccatcgacatgaacggctacaaggacagcgacaagctcgtggtgcagccgctcatcgaaggcgacggcgagaagctcgactcgaacagctacgcggtggtcaaatacaccggctggctgcttgacggcaagcagttcgactcgtcgtgggaccgcaattcgaccttcgacgtgaacatgcagggtggcgtgatcgagggatggctcgaaggcctcaagggccagaaggtcggttccgaggtgctgctcgtggttccgccgtcgctcgggtatggggaccaggcgcagggtgagatcccggcgaactcgacgctcgtgttcgtcgtcgacattctcgcgaagtactgatcggcaacctcgcatatcgcattgatatggaagcgctccgtgggcctcaggcccacggagcgcttccatattcgggcagataccggccatctagaacaggcgcagtgcgccgtcatcggtgcccttcatgtcgtcgtaatcgagcagcaggcagtcgaaaccgcggtccttggcgagcacctgcgcctgcggggtgatcgtctgtgcggcgaagatgccgcgaacaggggcgagcagggggtcgcggttgagcaactcgcaatagcgcgtgagctgttccacgccgtcgatgccgccgtggcgtttgatctcgatggccacatgcgtgccgtcggcgtcgatggccatgatgtccaccgggccgattgcggtcgggtattcacggcgcacgagcttggcgccctcccctatgcgctcgatctgttcggcgagataccgctgcaagtggtcttccacgccatctttgcgcagtcccggatcggttcccagatcgtgcgtctcgtcgctgtagatgtgctgcagcgtcacttcgagcacatcgttcgttttcgtggactgcacgcgaatgatcttctccggcgtgggtgttgccgggtcatcgtcggcgtcctgtggggtgatgtctttgatcgtgcacggggacagcatccagttgagcggcttgtacgagccgatctccgagaagatgagcaagctgttgtctgccttgatgagcaggactcgtttggcgagcgggagggaggccgaaaggcgtccggtgtattcggcgcagcagtctgcaacaatgattcgcatgccgtcaaggctagcggcccctctcccccaaccctgctcgcccatgcctctaatcggtgattggtgtcggatgcggggcggtgcggaaaggcttcgtcactggatcgcaagcgccctttacgttcctcaacctttccgcaccgccccgcatccgacaccaatcaccggcagcaacgcctcaaggcttccgccaattccatgcgttgacgtgtggttgccgtgggccggattgggcgggcggcagggttgaggaacgtaaagggcgcttgcgatccagtgacgaggccctgccgcccgcccaatccggcccacggcaaccaccaaggtctggaaatcgttgcctgaacggcatattctgtcgcccaatatgcgagtgggccacccggaaagcccgagtggcccactgaggggattggcgttgggttcagcccacgatgccgctttggtcggcaccctccgcctggaacgcgatggaacgcgcgttttcaacagccacggtgagtttgttggagtcgaaggagatgaagccacccgtcacctcgaacgagaacttcttgccattcgggtctgtgacgtccaaacggccttcctcgatcaccgaaagcactggctcatggccgggcagaatgcccatgccacccgcgtaggcgggaaccaccacctgcttcgcctcaccgctccagaccgggcgctccgacgaaacgatgttcactgcaatcgttgcgcctgccatcagtcaccgtattccttctgcatcttgtgccacttcttctcgagatcctcgatgccgccgatgcccgagaatgcctgctccggcacgttgtcgtacacgccgtcgcagatgcgggtgaaggcctcgatggtctcctccgcaggcacgtaggagccggggacaccggtgaacttctcggccacgtagaagttctggccgaggaactgctcgatcttgcgggcgcggttcactgtggtcttgtcttcctcgccgagctcgtcaatgccgatgagggcgatgatgtcctgaagctccttgttgcgctgcagaatcgccttgacgcggttcgcgcagtcgtagtgcgcctggcccacgtaccgcgggtcgaggattcgcgaggtggaggccagcggatccacggccgggtagatgcctcgcgaggcgatgtcacgggaaagctccgtggtggcgtccaagtgggcgaaggtggtggcaggggccgggtcggtgtaatcgtcggcaggcacgtaaatggcctgcagcgacgtgatcgaatggccacgggtcgaggtgatgcgctcctgcagggagcccatctcatcggccaggttcggctggtagcccactgcggatggcatgcggccaagcagcgtggacacctcggaacccgcctgcgtgaagcggaagatgttgtcgatgaacagcagcacgtcctgattctgcacatcgcggaagtactccgccatggtcagtgcggtgagcggcacacgaagacgggtgcccggctgctcatccatctggccgaagaccagcgcggtcttctcgagcactccggcctcgtccatctcgccgatcaggtcgttgccctcacgggtgcgctcgccgacgcctgcgaacacggagacgccgccgtggttctgcgccactcgctggatcatctcctggatcagaacggtcttgcccacgcctgcgccgccgaacagaccgatcttgccgccctgcacgtacggggtgagcagatcgatgaccttgatgcccgtctcgaacatctgcgtcttcgactcgagctgatcgaatgccggcgggttgcggtggatgggccagcgctccttgatcacgatcttctcgcccggcttcttgttgagaatgtggccggaaacgtcgaacacatggcccttggtaacatcgccgaccggcacctcgatcgggccgccggtgtcgtgcacgatggcgccacgcaccaagccgtcggtggacttcaatgccacgcaacgcgcggtggagtcgccgaggtgctgttcgacctcgagggtgatgacggagtccttgacctcgccttcctcctgctgacccatctgcttgatctcaacagtcagcgcgttatagatgtccggcatgtggcccacagggaattcgacgtcgataaccgaaccctgaatacgcgtcacatgaccaacgattggctccgcagcctcgtcagcggccgcattagcttggttctcagccatttcgcgttcctactcttcctttttgttcaacgcatcggcgctgccgatgatttcggtaagttcctgggtgatcgacgcctgacgcgaagcgttgagcttgcgggtcagatcgttgatcagatcacgcgcgttctccgtagcggtatgcatggcgttctgcctgcaggccacctcggaggccgccgcttcaaacaggcattcatggatacgcgaacgcacgtaccttggcagcacggtgtcgagcacctcgtccaggctcggctcgaaggagtacaacgggcgcacctgcggcgcagtggtcgtgtccggcacattcagatgcgacttgtcttccttcaccacctcgaccggcagcatgcgcagcacacgcaccttctgcaccaccatgttgatgaactcggtgtagacgatgtacagctcggcgacgccgccctcgtcgaccggttccatgtatgccttcagcaacgcacgggagatggcattggcgacctcgacgccaggcttctcggtatcgccttcccaagactgcgccaacggacggttgcggtaatggtagtaagacaccccgcgacgtccatacacgtacagctgcggctgcttaccctcgccttccaagcgggcgagcagatcttcggtctcacgaatgattgacgaagtataggcaccggccatacctcgatccgccgtcagggcgagcacggcgacccgtgggttgccttcgtccttcttgacgatcggatgcgagatatgcgtgtgcgacaccaaggtctggacggcatcgaaaatcgcatcagtgtacggcttcgaatccagcgccaactggcgggcctgcgcgatgtgcgaagccgcgatcatctcctgagcgttgaagatcttctccaacgaacccgtggaggcgatcctgctttttaatgcgagttgcgatgccataggttacttcttttcctgagctttgccggccttgatctgctcctggtcgacaggggtgacgctcttgggagcggtcttcttgtcgacgagcggcttgcctgccttggtgacgtaggtttcacggaaggcgtccaccgccttgtcgagggcctcttccgtctccttcgtgaaatcgccggtgtcacggatcgtcgtgagaatatccgtgttgcgatccacatactccagcaggccatgttcgaacggcagcacgtcggcgatagcgagatcgtcgaacttgccgtgcgtgccggcccacaccgagacgacttcctgctccatcgagtacggcgagaactgcggctgcttcagcagctcggtcagacgcgcaccacggttgagctgtgccttcgaggccgcatccaagtcggaggcgaacatggcgaaggattccagcgagcggtagcgggcaagcgagatcttcagcgtgccggagaccttcttcaatgccttcgtctgggccgcgccaccgactcgagacaccgagatgccgacgtcgacggcaggacgctgacctgcgttgaacagatcggactgcaggaagatctggccgtcggtgatggagatcacgttggtcggaatgtatgcggagacgtcgttcgccttggtctcgacgatcggcaggccggtcatggagccgccgcccagatcgtcggacacacgtgcacagcgctccagcaggcgcgagtgcaggtagaagacgtcgccagggtatgcttcacgccccggcggacgacgcagcagcagcgagatcgaacggtaggcctcggcctgcttcgacagatcgtcgaacacgatgagcacgtccttgccgttgtacatccagtgctggccgatggccgaaccggtgtacggcgcgatgtacttgaagccggcggaatcggaggccggggaggcgacgatcgtcgtgtactccatggcgccggcctcttccaggctctgcttcacggaggcaatcgtggaacccttctggccgatggccacgtagatgcaacgcacctgcttcttcgggtcgcccgactcccagttcttcttctggttgatgatcgtatcgattgcgattgccgtcttgcccgtctggcggtcgccaatgatgagctgacgctggccacggccgataggggtcattgcgtcgatcgccttgagtccggtggacattggctggtcgaccgggtgacggtgcatgacgtccggggcctgagcctcgagaatgcgccttccctcgctcttgatctcacccatgccgtcgatgggccggcccagcgggtcgaccacacggccaaggaacccatcgccgaccggcacggacagcacctcgccggtacggcgaacttcctgaccttcctcaatgcctacgaaatcgccgagaataaccacgccgatctcgcgagcgtcaaggttgaaggccaggccaagggtgccatcctcaaaggtcagcagttcgttggccatgcaaccaggcagtcccgtcacatgcgcgatgccgtcaccggcggtcgccacatggcccacttcctgggtcggcgtctccgatggcgtataggcttcgacgaaatcgtcgagcgccttgcgtatcgtggcgggatcaatggtcaattctgccatgatcactccttatgtttgtgtatacattcaatcggccagccttgtaggccggccacgcgcaacctactcgctcactccggctttcaccttgcgcttgaggttctccagctgtgcgacaaccgtgttgtcggtgacctcatcgccgacctggatgcgcatgccacccatgacggtcggatccaccaccgaatgaatatggaccgggcgcccagtcttcttcgtgtagatccgcgccagcttgtcggactgctcgtccgaaagcggggtcgccgtcgtgacggtgaccatcgattcgcccatgtggcgggagaacttgttgatgagccattgcaccgattccaggtaacgacggttacgcgggttgcgtgtgcaatgctctgcgagacgcacggtgatgcggtcgaaatccgcaccatcgatgagtgcatgcagcagttcgtagcggacgttcaggggcccttggctgtcggacagatccgagcggacgaccggcaggttgagcagtgcggactgcagctgcgccagctggacggagaccttgagtgtcttcttctcatcgtcggcctgatacatcatggcatccacagcgaaatcctcgatcgcgttgtcgatgtcacctgcacggctccagctgcggccgacaagatcggtgagaatctccatcgtcagcggcaacgcctgcttgccaagcagattgttgagtaacgccaccttgtcttccgtcggtcggccaggatcagtgagcgcacgcggaatgcgtggattgtggtcgaacacgtacgtgatggtgaacagctcattgccaatctcccacgcatcgttacccgactcacgcagcttggcggcaaaggaatcgcgcgattcgcgatccgccaagcgtgacgcctctccttgcatcggtcacctccctttcttcactcatacgcgcgccaagcgcacgtgggtgacgtagcactacttcttgctttcgtcgttttccatgtcggcgagcatctggtcgatcatctgcgtctgcacagcagaatcctgaagctcggagccgagaatcttggaagcgagcgaggtggccagagaaccgacctcacccttcagattcaccatggccttctgctgctgggattccagcgagcgttcggcattcgcggtaatctgcgcggcctcggtctcggcacgcgaacgggcgtccgcgatgatatgcgaagcctctgcgcgagcgtcgtcgcgaatcttcgaagcctcgacgcgagcggtgctcaactgagcctggtacttcttcttggcctcttcggcatctttctgggcttgctccgccttggcgaggccgccctcgatttttgcggtgcgctcatcgaaaacagactggaacttcggcaggaagaacttatagaagaacagagccacaatgatcagaatgatcagcgaccagacgatgtcgtatgtttccggcagaaacaggtccacgccgttagcagcaatggtcacgtcctcctcctttcttgtcctcgtatgatgtgcttcggattagtctgactcgatcactggaagatgaatgcagcgacgaagccgaggagtgcgaggacctcgacgaatgccaaaccgaggaacatcagggtctgcagacgaccgccaagttcaggctggcgggcggtgctctcgatcgtcttaccgatcaggatgcccagaccgatgccaggaccaatggctgcaagaccgtagccgacgacgttcaggttgccggcaacctcagcgagggtaacgatatccattgttatttcctttctggtcattgcttttcagcaacagttatttgccggtggtcagtcgatctccgggtagctcatattgatgtacgcggtggtgaggatcgcgaagatgtatgcctgcaggcaggcgaccagcacttcgaacaggtacatgaacacgcctgcggcgaaggtcacgacgccgaagggcatcatgaacttgttcaccacgtcgatgaggaagtactgcgtggccgataggcacagcgcaagaatgagatggcccgataccatgttcgcgaacagtcggatcgtcagcgagaacgggcggatgaccagcagctcgagcagctggatcggcgacagcaggatgtagatcggccacggcacgcccttcgggaacagctcgtcgcgcaggaagtggccgagccccttctcgcgaatgcccgcaatccaatactgggcgaagcaccacatggcgaagacgagcggcagcgtgatcgtggcgcttgccgcgatgttcatgccggggacctcgccgcacagattgaacaccagcagcgtgaggaacacggtggtgatcatgggtacgtagcgcttgccccgcacctcacccatcacctggtacacgatgtctttcttgatgaactcgatgagccattcgacggcgccctgccagcggccaggcaccagtttggcgcgcgcagcggtgattcccagcaccagcagcatgatgatcgtggccaggatacgcacgaagatgatgcggttgattgcgaacggcgtcccctggaacagaatctccggtgggaggaagtcgtcgatgctcggcatttccatcgatgactctgcaagcgtcagtgcgcctgcgctgaatacatcaaccattcatgcctcctgattgtctctctgctgcaagtctatgccttggcgccgcggcgattgtgacaagtctgttacacccgccacggcatcgctcacggcaatctactgcataccttacttcgcatacgctacggtcgccgttgcttacgctcaacgaacagttctcgccagccgcccggcaggccgccggacaactgaacagcgattattagcccgatagtggacataacgacacggcaccgacaccgccgtgccaacaccagttcggcggtgggcagcaagggacgacgggccttatttgaggccgtaacccgacgtgtcgaacggcaggaactgatcatcgcgcggcgagcaaggggcgtgtcgaatcgaacggtcggtgccgagtctgcgttcggcacgcagctgtggaacctcggacagatcgtacggggttgtctggtatacccagttgagccagttgcgccacaacaggttcgcatgcgcgcgccaggagaacagtggggccaaggcagggtcgtcgttcgggaaatagttgcgcgggaacggcacattgctcatgcccttcgccatatcgcgccggtattcctccgccagcgtgtacttgccgtactcccagtgcccgagtgcgaagacctccgaaaaatcccgcgtggcgatcagcccgggaccggcctgcggcccccaggtgagcacctgcagttcaggattcgcggcgatgtcggcctcgttcaccccggccaatcgagaatgcggctgcagcgcgatctcatcgaagccgttcgtgaggaagcaatactcatcctgcaggaattgcggaaacacgccgaacagcttctcgtcgagatccatcttgtgcacgccgtagcgctggtagagcgccgccatggcgccccagcacatgtacatcgtggagaacacatgcgtggaggaccaatcgagcacgcgcttgaactcatcccaataatcgacgtcctcgaaccgcagatgctcgacgggggcgcccgtgacgatcagaccgtcgtagcaattgccctcgtacgcctcaagcggttcatagaacttcactaagtggtccgcgctcacatgcttcgactcatgcgtggaggtcttcatgaagtcgatctcgacctgcagcggcgacttcgagatgaggcgcaacagctgcgtctccgtctcgatcttcttcggcatgaggttgagaatcaccattttgagcggacgcacacgctgacgctccgcctccggcttctcgagcgcgaagatgcgctccgagtcgagaatggcgcgggccggcagtccgccgggaatcttgataggcatgctccaattatgggcgaacgttcttacaacgcaaccgcacagtacgcatgccgatatgcaatccaaagaatatggccggcaggcgcaaagcacccaccggccatatcgcacgagtctacgtcaatgctcctcggcggcattctgagctggtttcggaatgagcagcgaactcaggaatgcaagcaccagcagaatgatgccggcgatcatggcaccggtgtaccccatcgtggcaccatgcgcgtcggagaagccctgctgcacgccatagagaatcgcatagctcaagccggcacccaggttgaatgcgccggcattcaggccgggcaggtaaccgggattgtcttcgggggacagcacgatgccgaggccgttcagcatgatgttcgcggtgccggcatagctcaggccaagcaccacggagagcaccaccaatccccagatatgcggggactggcaaacgaacacaccgaacaccatcgcgatggcggagacgatgagaccgccacgcaatgtgctgcggtaccccatcttggaggcgatcacaccggcgaccgggccgaacaccagacccaccaatgcatacggggtgagtgtggcgagcgagacggtgtcggcgctcatgctcgcaccgaccgaggtgtcttgcgcaagcgccggaacaatgccgttcatgacggcgaacacaccggtcatggtgagcaaggtggtgagcaacaggccccaagtgcggcgttccttgagatacgtcgtcgtgaccatcgggttcttctgtgcattttccacatgccagaagatcacgaacaggacggccgcgacaacgatctcgatggcgatgagccaccaattggcaccagcgagcttctcgatctcgttgatggcgaggtacgcggccaggaatgcggcggaaaggagtattgcgccgagccagtccatctttggggtctcatcggcagtcgactcacgggcgaacgaccagaccagcacgacggcgagcacggccacgccacacatcacccagaacaccgaacggaagccgaaattgccggcaagccagccgccaagcaacgcatccacgccggcgatgccgccattgaccgaagtcaggatagccatgagcctcgcgtaccgcgcattgtcggtgacctctgcatgcagcatgagcaaggtcattggcaccacaggtccggctacgccctgaatcacgcggccgatcatcaacatcgtcacattggtcgcgcaagcagagatgacgcagccgatcgccgtgcaggcgagcatgccgatgagcaccttcttgcgccctttgagatcgccgagtcggggaaggaacagcgagaacacggcgcaggcggtgaagaacaccgtttgcgtaaggcctatctcggcgtcggtggtgttgagttccacacgcattgtcgtcaatacgggtgaaagcatggaagcgttgagctggaacgcgaagatggcggccatcaacgcggccatcagcgcccctacatgtttggcatccacctgcttcggtgcaggcgcattgtgcacagaggtcatttcgaccctccctatgaataatgattcgttgagttatcggatatgcggtcacacggctctggtcgcacgactgtgaaacgaggatgctcgagtgtgcaggaagcgcggcccgctcaccctatgcgccggatggcatcggtcaccagattccagaacttgtcgaaatcgagtttcattgccacctgggtgtggcattcctccgcgcttggctcagggccacgcagatcggccaccgtcatgccgagcgtcaattcgccgcgcagctccacatccaccgggcaccggcgtgtggtgatcaccgtcgggtcgatgaggtacgccacagtgcacggatcgtgcacaggaggatcgacgaagtcctggttttcggcataggatttgcggaagaagtccatgaggccggaaacgaaactcgcaagcggcgtcccgatgccctcgatcatcctctgcttctccggcttgcacagggcctgatgggtgaggtcgagaccgatcatggtgaccggccacttctcattgaacacgatgtgggcggcatcggggtccaccttgatgttgaactccgccacggcgctccagttgcccacatgcacgccgccacccatgagcacgacttccttcacacgctcgacgatgcgcggttcgagtcgcgccgccagcgctatgttggtaagcgggccggtgggaaccagcgtgatggtgccgggctcattgctcatgatcgtgtcgatgatccagttgacggcatggccgggatcgagcggacgcgtcggctccggcaattccacgccgtcaaggccggtctcgccatggattgtcgccgcaacctgcgggtcgcggatgatcgggcgcgcacagcctgcatgcacggggatgttgggcgcatgcgccttctcgagcacggcacgcgcattgtatgtgactttttcgaggctctggttgccgccgacggtggtcacgccaagcaactcgatgttcgggttgccgatggcaaggagaatcgccacggcgtcatcgtgcccgggatcgcaatccaaaatgatcttcttcaccattgttcttcctcctccagtttcctgggatttgtttctgacgcgaatgcggggctcctgcgcccttgcacgagcacttggacgaatccggtcgacgtcgaccggatcgtatgcgatgcatttgttcagatgcccatatcatagaagaaattccgatgacgcattggcggtaatccgtgggtaaaacccgcccgaaagtggtaaggcgacacgccggcttgactaaccctcaagtctgagtaatattaacttttgctgtttgaaacagccgacgcggggtggagcagctcggtagctcgctgggctcataacccagaggtccatggttcaaatccatgccccgctactaatcaaagcctagaaatcgtgcggtttctaggctttttattttcttcttgccctacgctagaacgcggatttggacaaattctggacatactatcgtccactcttgctcttcttgctcttttcctcgctatctgcacgtaacttttcatactgcactcgctctgccttagtaggacttgcaagcctatccggtagatcatttaccgcaagaattggctcgatgtacagcgaatatttgtaatgtcgttcatttaacccaagcactctctcgcattcttcctcaagctgcggcggtatggttatgccgtcttcaagaagtaggcgacggattccatatagattcgtaacatttgactccagataatcgaaaacactggaatagatttccgccggactgataccgtattcatccttttccgtagacaatgaatactttaaggagctttctgcaatctcttttaccgtgttcaagcttttttctagttcgagaattctattctgctggaattcacccatggctttccccgcaaccatgccccgaaattcgtcatctagagggaaacgatcaggtttgctctggatatacttcagcagctctcgtcccacgaaccgagaagtctcttcgctggaggggcatcctccacgaacagcaccccaatcgatgaacgggatactcgtttcagtctttcggtgaatccatttaagcccgatcattgcccttgccgctgtcatgaaatctggtgcgaatggtgtaaaagtcacccacttaccctcaactttgagcgcacagacccaaccatttcgaagcacataccagttttcacgtgccatcatgtctctagccaattcagtggacactcgttcgttgtcgctccttgccaatgatccttgcactttcctcggaaagagagtcgcactcacattcaggccgtcaacaaactgttcaaagtcgtccggcctttcgaaattcagaacctccctgcgcaaacgccaaagttgcctgtacctcttcagctccggcaatggtatatccacgttcatgagaatccgaagcacatcatcaccagtgagctttgatcgtcctgtaaagatgctcttggttctatctttgctgaatcccagctgcttacctacatcttgcagctgcatgtgctttgcttccgcatagttccttagcgaagccaccaacattttgctatcgatctccatactcacctcggccgtatcttttttcaaattttgttatcccaatgatatcaaggtctcaagccacatcaggtgtaatttctgcactcgaaattcgtcaaaccgaactgcatgtttttagatggaatcaccgacgaacacgaacgaaaggaggtgagcaacatggcaaacaccacggacccgattttgcacgtagaaatcgtgcagggtgtgagcaaggcgggtaagccatacgagtgtctcgaagttcttcttggagaggactccgttggccgtctcttcccaactccactggaaatgcgctctatcaaagccgctctgcaagatgaatcagacatgacgttctgatttctcctcaatggctgtcccgaagtgccggagcgaacctcagcttcggcactccatcttcactgttttcacatttgtcatattcgaaccagtccaaggagaaccaatggatttcatcaccaaagcgcaactgttcgcacaagaccacttcatcgtcattgcaatcgttctcttcgccctcctcgctgtgtgcgcgttcttcatcgcacgtcacaacagccgtgcagcccgcaaacatgacacactgtgcgcaaaaccactcagcctgtcgccagacgaggagaaagcagtgaaggtgaggtacgcgaggaagcccaagcgcgtgattttcttgctacccgccgcactcactacagacgaagacgtgaatgcatgggcagatgcggttgccccacgtctcggccacgcattccaagcagtgaacgtggagacaatcccacagggactgttctcaagagcaaaatacagggtcacattcgcccgattagaggagcttcgatgaatatcttcagaaaccatcggaaactgccgtcagaccgatattctctcggtcttgacatcgccgacccgaagaggacagtcacaatcccgcgatctgcacatcttgccgtcatcggagagtccaacagcggcaaaggtagcgtcatcgccaacatcatctctcaggaggtggcattcggcggagaaatttggttcatcgatctgaaagcaggcatggaagcagagaactactgtaacgtgctggcccgtaaagcctacaccctcgaagaagcatatgatctgctgactgatttcaactcgaatgtggacacactagccgccgaatggcgcggcaagacgcgctccctcaccgacgcccagacatgccaccgactgcttgtcatcgatgaagcggcggacatggttcgatcgggcccgaacaaaaagctatcagactcgtgcatcgagttggtgcgatcgattctctcacgatcccgcgctctaaactgcacggtcgtggtagctacccagaacccgcgggtaagcaccagcttgccatatcggagcttgttgctcactaccgtggcacttcgattgaactctaaaggcgaagccaccatggcgttgggtgaagatgcagtgaagcgtggagcccgcccatggcagatacctttttctcgacctggcgatgggtatttgtgggataccgagactaatcagacggtctatctgcatgttccattcatcagtgacgaggagctgcaccggctgcatcggtgactcggctggcgatgggcgaagcgtcagcgaaagcccagacccagcagagtcgccgcctgaaaggtgtatgggggcctactacgactgcccccatacgagatgtgagatgcgagaaaggcgagaatatgaccgacgataatacgcaaaccagcctgaacgacaagggtcggtattgggcgggcttgatctaccccgacagctgtcccgatgactggaaagcaaccatgcaaatgtcgggtttgcagatactggtttcgccagtccatgacaaggacatcgaggatcctaagactgggaagttgaagaaaccacataggcacgttgtcgcaatgtggacgaacacgacgacacgtcgcaatgcgacacgtttcttcgagcagtttaatgggccgaaaaccatactgcgagtggaaagtccgcgcggaatggctcgctacttggtccatctcgataaccctgaaaaagttcagtatctgccggaagatgtgattgagatcaatggagccgattggaagaaaatcgcgctcacagatgaggaacgaccagaagttatggaacttctggaactcattgaggagtgggaggtgcatggctactttgagttgctcaagctctgcgagctcaagaaaccgaagttactaccggtcgcagccaaagcgacaacctattgccgtgaagtcatctggtcatattggcagttcaaagaacggaactcgaagttcaaagacgaattaatggaacgtcagcgtgaagaactgcggaggaagaaagccactgagcagacgaagcagcgtgcgcagagaaagaagctcgatcagagcgctcgcaaatctcggaaaaatcgtcgagtaaaaaaccaaccgcaaaaaagcgccaagaagcagaggaggaagaaccatggccaccgtgcctagcagcgaaaccccgtcagatcgactgaagttctacgatgtgaacgatctacggcagatgttccatgtaggacgcaataaggctcgcctaatgatggacgcgcttccctcgattcgagtcggcagcaaggactacgtgacagagagcgctctaaacgcgcacatcgcagagcatggaggcattctcgtgaagtggcctaagcgcaatcgttaggccactcatagcacgaggcttacttgttgctctttttgatgttgtccttgacacagagcatcacacaattttcaagaatcgtcttgccgcccttgctccatgggatattgtgatctgcttgcatctcggagagctcgaagtgttgctggcacaacgggcaaatgcccttttgcttttcgtaggcagcacgcctatctcgatcggtgaatgcgcgaatattcaggacgcgttcatggccggtcagcaagtactcgtatacgccagactttcgagttacgtcgtcgtctgccatcaactcactcactcgatcttcaagtgccttggggtcgtacttctgctcatgatactggttataccagagaccccacggaagccctttcatctctcgccgatatacggggaagagtgattccgtccactcgattaccgtacggaaataactccacagctcctgagcagtcgggtcattctggtgcgccgacatgtatccatcgaccgtagtgccgtcacggtctgcgatccattcgattgctgtctcaaggatctcttgtcggatactctcgcccttgacgtaaccgttacaacccttgctgttcccataacgggccgctgggcagtttgtcttcgaaaaataacgttttgcgtccgatacccacggccctgcatacacagcattgcggagctcttgattagtgagccgttctcctgcaatgttgatggtcttgaaccacttgagtttctcagagtccgtgccatcacagatgtagacgagaagttcgtaatcaagaatcctctcctgaacgtcttcgggaaggttatcgaagttcatagcattgttctcgtacttgattgagaaattgccatcgacgtattccatcaggcttatggtgcgctgttggccatcaagaacttcatacgtgtcatcgcctgttttagcccaatacatcacattgagcgggagcccctgcaatacggtatcaatcacggcatcacgcttcgcgtccttgtaaacgaattcacgctgatagcggggacgaatatccaagcgatcgtcatagccgaccacaccctcttcatcatcgttctcatagttttcatatacgtcgcgaaccttgatgcggttttcagtgatctgcattactttccttgcgcttcttcgagagtgactgtttcataggggcgaggttcggggtgcaagttgcggacaagtatccgcccgaatttcagcttgccgttgatgtatgggccgtccttaccagtagaggacggaatgccggctaatccccggatattgccagcaagtagcccgataatctcgaactgatccggattgaacttgtccatgaatgtgacgggtacacccatgattccctcataatcacaaggaatatcaatcaccttaccgacattgatggcttcgtaattgtcatactttgggtaatcgtcgcgattgtaacgcttaaccagaactaggtcttcatggcgcttcttgatgtcgagattggtgtaccaacaggcatttcccatggatcgccacttctgcccgctctcatcttgccaatatcgcgttttacgcggctcatagtcatctggaaccttaaacgccatatcgccacaaccatagcccagccagactttgttatcccgcaatagggggaagaactccttataggtgatagcgttttggttaccgatgatgatgaatttcttatcatgctccacaagggtagacacgaattcacggaatttcgagaaaggcggattggtcaccacgatgtccgcttcatctagcaatctcaggcattcttctgatctgaaatcgccgttgccttctagacgttcgcaaaggttctcgccctgcttgaacaattcggccacgtcaaccatgctggtagcaccatcaccattggcatcacgcacagaagtcacaacagccttgtaaggcgtgcgcctttcctcttctgtgtcgtcaccgaaaagcgtgagctcgttccctgttatcggggatcctgaatagcaagttgcaatgagcttcttcaacttcagacgattgaaatttaagcagaaatatttgaagaaattagattcgaatggatcatcacaattgcacaacaccgtcttgcccgcaaaatgcttccgataatgtttcaactcagattcgatgtctgacaactgagtgtagaactcgtcttctttcgcctgatttgctcgattgagaggcgtagccatgcctgtatcaccaccatccattcattctgatcgattaattatatacaccctagatcttcagcactaccgataacccactattccaacagcttgcccataaaatcggcagccttacgatcattctcgcccacttcttcggcatagatattcagcgttgtgttcaagctctcgtgccccaagcgcgcctgcacagtcttgggatccactccccccgccaccagcagcgtggcttgagctcttcgcaatgcctgaaagttcgggccgatgtatcccgaccgcttcactcgttctattccgcgacgatcgatataggttgattcgtgcgcgtaatgtgccagtccctcttcaacatagaatttcctcctccatctgctgaagttgtcaggatcgaggaaaacgcacagatcattactgcatactggcgaggattcctgcaaagtaagccccacttctgcaaatagccctgcttgcttggtcttccacttcgtaaggaattctacagtctggttatcaatagaaatcgtgcggcgagactttgctgtcttcgggtctttaagtactttctccttgccgtactgtttacgaatccggagacgtgcgttctctaaatcaacatcctcccagacaagcgccagcgcttcgccgcgccttaagccagttgccagaccaagccagactgccacaatccgaccgtcttgcggctcattcttaagcttgtgcacgaactccaaggcctgttcttttgtaattcgcgtttctttgcgtttctgcggacttacctttggacgtttgatatcctctacggcatcgcatggattacgctcaatcagttcctcgaggtaggctttgcgcatgatctgcgccaacttcatatgcaccttatgaatcgcgtcaggcgatgcgttgtcttgctctgccatgtgcaagtatgctttctctatacgctgtgcatctagatccactacgcgaacatcaccgagaaacttcacgatgcgatcaatctcgtgctgatctcgttcgatagtcagcgaagacacctttccgagagccctcctcttagcttggaaatcggttgcatactctccgacagtaacgctcttcccactacgagcatcttctagctcctgcctgtaagccacgagagctgctgtggcttctgccttgtttccctgaaccttgcgactctttgaccagtgccacgattggtgagtatcgtccggtgcaagtcgcacacgaatcgaataccgccgaccgcgctccaactctttgatctctcccgatgtctctcgcttcgccatctttgacctccttcgtatgtatccagtgtatcatttctggacaattctggacatggatgcagttggacaaaagttggacaaagtcaccaatcaccattaacagaaatcaatgaattacggcgtttctaggtcattgtcaagacctagaataaacaataccaaactcggataaactgtagaaacgtgggctcataacccagaggtccatggttcaaatccatgccccgctaccactgagggctaggaatcgaattcctagcccttttgcttttccagcgcatgaaaccgactccgcgcaccaatcgaatctacgtcaccgtccacactccccgttccattggccagattgggagcgccagcgaaatataaccaatgagcgagcacttacggcggccattttgtgaatatactgcctcgatggccaacaagatacgggaaacacaggaccgggcacacggagcgaaagcgacccatacaccgaaaaccgatctcggaaaaggcacctcctccacgggctggaacttgcccctagtagctgaaacaagtctcaataacgacgtttcgtgcatatattgattacaactgattacaaggaggtcatgtatggctgacaaaagcactgccccactggcaggcatcaaggtaatcgactggacgcaggttcagtctggcccttcgtgcacccagattctcgcatggctgggcgccgaggtcatcaagctcgagaaggtgcatggcggcgacccgacccgtaacgagatgaacgacgtcgacggctcgtactcgctgtacttcctgcagctcaacgccaacaagaagtcgatcacgctcgacatgaaggacccggaaggcaagaagatcctcaccgacctgctcaaggacgcagacgtgttcgtagagaacatcggcccaggcgacgtggaaaagctcggcttcggttgggacgaggtccacaagatcaacccgaagctcatcatggcctcgctcaagggattcaaccagggcagccgcttcgaacatgtcaaggccttcgagcctgtcgcccagtgcgcaggcggcgctgcttcgaccaccggctggtgggaaggcgacaagaacatcccgacgcagtccggcgctgcccttggtgattcgaacaccggtatgcacctgacgattgcaatcctcaccgcactgctgcagcgcgagcgcaccggcgaaggcgtgttcgtgtaccagtccatgcagaatgcagtgctcaacctatgccgcatcaagctgcgtgatcagctcattctcgatcacctacaccagctttcctactacgactgctacccgggctacaagttcggcaaagcgattccgcgtgcggccaatgccgagggcggtctcgtgctcggctggtgctatcgcgccaagggctgggagaccgatccgaacgcctatgtgtacattgtgattcagcagtcgcagaagggattcgagaacttctgcaacgccatgggcttccaggattggctcaccgatccgaagttcagcacgccgaacgctcgcgatgagcacaagcaggaagtgtacaagcgcgtcgaggaatacacgatgcagtacgacaagtacacgctcaccaaggaactcggcgccaagggcgttccggtgggcccggtgctcgattggaacgaactcgaaaacgatccggatctcaacgaggatggcacgctgatcacgatcgatcagggcgacgcccgcggcaagttcaagacgatcggcctgccgttcacgatgagcaactatgcgccggattaccagcgcgcgccgaagctcggcgagaacaacgaggagattctcaagtccctcggctacaccgacgagcagatcgccgatctggcgaccaagggcgtcatcggctcgaacgatggcgtcaaggcagacctcaccgccgctccggcacaggcctgattgcgctgcaccgctcacacgcggtcatagcctgctacgcgaagggcgggtttcgatatcaatgcggtatcgaaacccgcccttcgcatattgcatatgaagccggccggttccccgaacagtggaaccggccggcttcatatgagtaggagattctaggaattagattgtcgcagtgttctcattgtgtaatatgcgcccctttcagcgaaccttgcagctcgcattgttctcccagccccaaccgtcaccgtccgggtccacggaagcagaggagcagatcgggtacccatcatcggtcgtgccggaattgccgccagtgttacccgagccaccggaattggagccgccgccatagatgccggccttctctatgccgcggctcttcaacccgttggcaccattgacgaacatgttgccccagccggaaagcgagccggcgttccagttgttcacgagatcgaggtactcgacgccctcggtgttgccgcaccacgaccaggcgagcatgcccacgcccttttccttggtgtagctcatgatcgtcgcggcatccggaatgccgtcggagtgcttgttgccgaattcgcccaccatgagcggcagaccctggttcacgaaggagtcgatgtacgacttcaccttgtccgccgtgctgtacacgccgtacatatgcacatcgaacagcacgttcgaatcctgactgtacacactcttggcgttgtctttcatcacaccctgccaatcctggccccagttcggcgcagtgagcacgagtgtgtgcctgaaaccggcgtcgcgcatctggcgaatggcgtccttggtcccctgcgtccactgtgaagcggtgttgttgccgtagggttcgttgccgaggttgatcatcacataatcttcctggcccttcactgcgctgccaacggacttccagaactgcacggcatcgctcaggctcttggcatcggcggcatacgcggtgtcgccgtagccggtggtgtcgtgatcctcgagaatgcagaccagattgttcgacttgcactcgttgacgatattgctcacctcgctcgccgacgtcgtgccgtaacggcctccggagagcaccacgcgcacggtgttcgcaccggtgttcgcgatatccccgatcgagctggtgtgctccgggtaccactggtatgcgtggttgatgccctgcggaacgaactgcttgcccgccgagtagatcttgccgcccgagacgtggagcgaattgtccgccgcctgcgctgccgttgccggaagcaccgccgccaacgtcattgcgccgaccacggctgccagtgttttcttcatgttggtatgcatgagcctactttcttcttccactgcttcatcgcagatgtttgcttcattgcatgcaatcggaacacatttgctcagccattgagctgttccgattacgaatgtaaagatatcgtgaaactgaagcgcttcacaaccgagttgccgaatgctgaaacgcttaatctacgaaatgtgagacaaactgttcagaatacgcaatcagtgccgacaaataatctgcagattatttgaattccattgatatcgcaccggtttcatatttgccgattactggagaagcgctctaaaatatcatctctcatggtagatttccagctcagctgcagttttccagatttagcgcttaagcatctccagcaaaaatacgcagcgacaggcaccatctgccatcctcagctatcctctgccacctctgccacctctgcaccctctgcgtaaaaagagacagatgaaaggatccatatgtccccaattacgcaagagactggcaggaggctaacaggagactggcaactgcagtctacaactgcgtaaaaagagacaaatacagcgcacagaatgtcccaaattacgcaggagattggcaaccattcctccctcctcaaacctgcgtaaaaagagacagataggaaccgccatatgtccccaattacgcaggaggtaacgactaacgaccgccgcgcaactcttccctgcgtaaaaggagacgtatagagaccgctatatgtcccaaattacgcaggcgaagcacatgtctccaattacgcaggagaagatggcgcgaaaatctgggccaatgcaagggaccccggccacatgcatggtcggggtcccgaatatttatatatatatatagggctgaatcagtggcagcacagcggcacgagccagatccacagcaggcaggtgacggcgaacgcaaccgtggagaccgcggtggtcgacgcaccttccttgacgtagatgttgtagcggctcgagatgatgatgccggagaatgcaggcggcagggccacagccatgacgagcatggagagcttgttcacattgctgcccatgcccagcagcaggccgacgccgaggaatgccgcaggggtgagaatcaagcggtagaacgtgttccagatcgtctcccagcccagcgagaacttcacagtggagagcgcgaggccggcggccagcacggcgacaccggagttcgctttggcaatcaggtcgaaggtgggagcgaaaccggacggcacgcgcacgccgatgagcacgagcacgatggcgagcagcggagcccagcacacaggctgcttgagtgcgttgatgagcgcttcgaggttctggttcttcttcttgcccatgttcgacgacttggagatcatcacctctgccgtcttgtcggtcttcgcatccttgttcggatcgacggcgatatcgtccttcggattggcgatgctgacctggcccttcgagttcgtgacggcggccttcgacaggcgctcgcgatccttgctctggccgaggttgatcagatacatgccgatcggaatcgtgacggcgttgacgacgatcgagatgatcgcgatgacgaggttcgtgctcacggtgtcgccgtagatcgggtcgagcacggcgaagccgaggaagccgatggtcggcgagccggcgatcaacgcgcatacggccgcttcctggatcgaatggtggaacatcagtcggcacaggtagtagctcaacatgaacatcacgatgatgccgatgaagccgagaattgtgagcaccgcatcctgtgcgagcatctcacgggtcgccttgacgatcgagatgaacagtgcggcagggagggcgatgttcagcacgagcttgttgaggccctgacgctgatcgttgtcgaagtagctgagttttccacagacatagcccaacgccatgatgacgatgatggggatgatgtcgtctatcaatatctttgtcatttgtcttctcttgtcttctggtggagtgggcgggagcaccggtgccgcggcgcggatgacttgtcgtcataccacgccgcggcgctccggggcaccggagcgaatcacatatgggcgcccttgaggtaggggttcgcggtcatttcggaagtggcgagcgggccgacgacgggcttcgggttcaggttggagatgtgcccggactccttgcccgcataatcggcgagctgcacgtgcacgaggctcggcttgccggaggcgacggcctcgccgaccatctgctcgacttccgccggggtggtcgcgtaatagccgttgccgccgaacgcctcgatcatgcgctcgtagtgggcgtcgtagctcagcgtcagcggcgacgggtcgccgtcgtcgccgagattctcgaaatcgccgcggtagatgccgccgttgttgagcacgacgaaggtgatcggcagattgtagcggcaggcgacctcgacttccatgccgtcaaagccgaagccggaatcaccgccgacgtacaggacaggcttgccggtggccactgcggcgccgattgaatagccgaccgcgcagcccataacgccccacgtgccgcagtcgagacgatggcgcggctggtagatgtcgatgatgttgcggcaatcgtcgagcgtgttcgcgccctcgttggtcaggatcatgtccttgtgctggtcgtacaccttcttgatggcgccgagcgcgtcgtagtgacccatcggcacggtgttcgagttcacgcgggcggcgaacttggcatcgttcttctcggcgtcggccttgagcatgtcgagccactgcgcggacgccttcactggcgtcttctcgagaccggcattgatcatctgcatggcggacttgatgtcgccgaccaccgggcatgcgatggaacgggcgttctcgatctcgttcgggtcgatatcgatctggatgaacttgacgttcgggttccattccttgccctcgccgaaattgagcatccagttcagacgagcgccgacgagcagcacgacgtcggcggtgcgcagcgcgagaccgcggcagctcgccgtgcagtgtgggtcatcgtccggaatgacgcccttggccatcgacatcggctggaatggcatgtcggtcttctcgacgaattcacgcagttcgtcctcggcctgggccagcgccgcacccttgcccacaagcatgagagggttcttggcctcggagagcagcttgagcgcttcatccacagaggactgcgccggcggcattgccggagccggctggttcgcgacccacagctgcgactcggcgacatccttgtcgagcgtctgggcgacggcgtcgtccgggaaatcgatgtagacaccgcccggacggccggagcatgcgatgtgcatggcgcgggccacagcaagcggaatgtcttcgatcttgtcgatgcggaacgattccttgcagaactgcttcgcatagttcatttggtcgaggccttcgtattcgccttcgtgcatgtcgacgacatggcgagtggacgaaccgccgatcatgatgaccgggaagccgttcgtggtggcttcaagcagcggtgccagaccattgaggaagcccggcgcggaaacggtgagcgccacagctgggcgaccggtgaggaatccttcggcagcggcagcgttcaccgcgtcctcctcatggcgcatgccgatgaagcggatgcccatgccctgtgcgatacgtgcgaaatcagtgaccgggattccgacgacgccgtacatatgcttgacaccgttcttgatgagcgtctcggcgaggtagtggggagaatccgtgagattctggtctgagcttgtagcagttacacttacatcaaccattgcaaacatcctcctggtatggttattcacctcgatactaagacgacttttcgtgccgtctcggcagaaaagcgctcagcgtacatttattcgagctttacgcttgtcgcggcaattgctcggatcacatctgacagacgtccgtgaattgcctattgacaaacctgcagacaacgtatggcacacacggaactcgaaccgactacttcgtcttcggctcccgctcttgcgtaccgtttgcatttgcagactgcgcagggcgcgtcggtgcctcaggatgatgcggcttcgcaggcgcgcgctgcgccctgcgcacatccgcacgccgcttctcctcacgttccatacgctcctgcatgtgttcctcatgttcgcgctgatgttcggcgatccaaggatcggcgaacacccgtgtgcgatcggtggccttcttgaacgcggtggtggcgctcagcacataatcgaacagatcgggatcgtgattggcggcattctccatggcacgcctatgctgtcgcaatacgaacttgcgccagccggaggtcatgagcagatcgatgctcgccccatacatgcccgccggatagccgaacatgaacgaaaccgccacacccacggccagaaatggtgccatgccccacccaaagatctcacatcccaacagaaacgcgctcaccgggcagcggttgaatgctgctaggaaacacaaagcgccaaccgccacacccatctgcgggctcgagccggtcatggcgaaacacgcgcctcccaggaggccacctatgcacaacgacggcatgatctcaccgcctttgaaccagaaaccgaggcagatgaaggtgagcaaccccttgattgcgaaatcccacgacacattgggctgtgcaagcatgtggttgagcatttcgccgcccgaaccggtgagcctccaccacccgaacacggagaccaacgtggccatgatcagaccaccgacaaccacccacagataatagttgcgcacaatctgcatcgtcgtgttctgtagcaggcggatgcacagcgcgaagatggagccggccaccgcacaggcgacacctatgacaaggcagatgcccacggcacgccaggtgaattcgggaatcggcaccgtgcaaatcagatcgccgatgccgaaatggcgtgcaatgaagtaggcgacgaagcaaccgatgagcatcgacgccacatacctcagctcgctgaagcgcatgaactccaataccagcatgcaggaaccgagcggagcaaagaacaatgccgagaaggtggcggccatgcccatggaagcggcataggagtgcatactacggtcctcggctgcgccttcctgaacccgcagcacatcgtgcaacttaaacggtttggcaatggtggctcccagactcgcgcccatctgaagcgctccagcctccttgccaacggagccgccagccagaatcgacatgccagtggtgagaaagatgcccggcgccagcaatcctcgcaccgtccgaccgtgcctcatgcgcgcaatcaccgattcggtggtctcccccagcgggatgcggaacatcttgtagaggagcaactcgagcaatccggccaccggcagcagccagatcagccaggtgttgcgcacgaagacactacgcatggcatcgacgaacaggcagagcagaatcgacccgaaacctccggccacgccacacaccacggcgaacagcaaatgcttgaatgattcccgccaatcgaaccgtgccgcactgcccttcacgcgtcccgacaggccgtttccctcctgcgtcaagggctcaggaggtccggccgcattgccattgtggggcgattgctcgctggtcatgcctgcgcccctccgttctgctctgtgctgcgcctgattcgtctccatttttgcaggcgcccgacgcgcgcacaacggaatgcgcagttcgcgaattcagcccggcgcaccgaacgccaaccggtgcccgcgccgaatggactccgcgactcacgcattccgtcgactccacaaagggtgtcattcaacgagcctacctacagattccggttcctgcgtgctatgagcaatccggtgagcaccatgaggccaagcgcgccagtgatgacggcaaaggcaaggaacacgtcggctatgacacctgtcgccgcgaccgacgtgcccgaacctgcgttgccccgcggtctctgcggttccggcggcttgggatagatcaccgtctgccccgcatcgtcgatgtcggcatgcatggccacctgtttgccctcaaccatcagccgttcgaatgccacagtctgcacttcgcctgacacgttgccgagttcggcgtcaaacctcaactcggcggtcccagttggcttggctgcagtgaatctggcgaatgcagtcaccggctggccgtccttgttcctgagcacaccgccatcctcgccattggcatctcgtatgtgcagttctccccgcacctcatattctttgcctacggtcaatccggtgaaggcgaccgtatccacctgtgagattcgggagtccagcgttccggaatgcgtaccagaccgggcgtcgcgggcctgcgtgccgatatcgatgatgcgcacggtctggccctcatctgctatgtcggcatgctcggccgtcagctgttgcgcgtcctgcatcggattggagtacagtcgctcgtaggcgaccaacacaacattgtgcagatcccgtttcagcacggtgaatctgaattcgagcctcgccgtgccgttggaccgtttcggcgtgaattcgacagaggcgaccaccgtattgccggcatggtctttgagcacaccggcatcacgggcatggccggcattgtcgaaaccgcgcaaatgcagttcgccatccatccgatacggcatatctgccagcagattggcataggccactgtgtcggtgagcaccacttccacctgtgatacgtcatcgtcgctttcgcgcacctgtattcccagctgtgcgtccagttgcgcctgcgagaccgccgaagtcacctgcaattcgtgggcgccgccctcggtcgtcaactgcgtgcctatgctcgcgatctgcacctcctgatgctcgtcgttgatgtcggcgtgctcggcgagcatcgtatggtcgcgcagcagggtctcgaacatcacgcatcgcttgccttccaaccgcagatgcccaacgtccaacgggaactccacatcgacggtgccatccgcctgcccgggggtgaatgtcgtcgtcaccgtcagcgtgttcccgtcaccgtcggtgagcgcgcccatgtcggaaacggtgccgtcatcacccacgaccttcgcatgaatggtcgaaaccaactcgtaatcatgccctggactgaggttgcggtactccaccacatccttcaccacgccattcgtgatcggcagcaacgagtcaccgtcaaaggcatccgaggccgatgtcgcgatggcagggaaacgcacgtcctgccgctcatcggcgatgtcggcgtgagccgcgaagtccacgccgttatgctgcaggctttcgaaggccactaccgtcttgccggcaaggtcttcgggcggttcgaacaggaaggtcacgtcaaccgttccgtcggattggctaggtgcgaatggcagctcggcggtcacctccttgccgtgtcggtcgtgcaccactcccccgtcactcaccacacccgtgtcgccgaacgtgcggtagtggagcgttgccttcagcgtgtagggcttcccggcaacgagattcgcataggacaccgcgtcagtgattgtcacggattgtgcgctcgcattggcttcgtcgtcgatgtcggccgcagcattcgtatggatctgcgggaagcgcagttgctgctcggcatcggcggcgtcgcggtgctccagcaacgacgtgccgtcggcattgcgaatcgtgcggaacgccactaccgtcttgccggcaagtcgttcggcatggtcgatggtgaaagtgagcttggaagtgccgccatggggattgccaaccttcaactgcttcgtggccttcgccacagcctcgcctgaaatcctgccgttctcgatcacgtagagctcgcccgaatcggtgtacgttcctgccgtcacgccccagtattcagccgaatcgaccaccgatagcgttccgatggcaggcgcgagcttgtcaccggcattgccgtcatcgccaaaggcatcggcacctgcaccgaagtatgcaagccgtgtggtcatgcccatcgccacattgcccagtgttccgtagtccatgtccacgccgttgccgtccgggttcaacgaaccgtcgccgttcctgctgaattccttggcggtgagggtcaccgaaagcatgcgatgcccgtcgttcgcgccgggtgtggggagttcgacgagttcatagtcgtcatagggcaatgcgcgcaatgcatcgttcacctgtacagcacgcttcgcaccatcgcgcgtcacctcataggaggtcgcggaggtccactgcaccgactggcctcctgatctcggcccgatgccggtgaaccatatgccggcctcggcatcgagtttcgacgcatccttcaccaccggattcccttgagaatccttgccaaccgccccgtttgcgttcacagcgtccgggtcgttggcgttcgtgttcctgctgtgcggtcgacatccggtggtgccggtcccggagtcattgaacctgccgtcgcatgatttcgtatggagttcgccgttcttgtcggaaacaatcacatggctttccccggtcgtcttcgaggtgagtcgccaggcgatcggccccatgcgctccatggtgtcggcgcttttcttgatgaagtggaaatccgcgcgctgcacttggttggacgcggaacctgcacccgatacatgcgccaatgaggcataccgatgcgggttgccattggcctcataggctccggttgacgcatcacctccatcatggcctatggtgaagcgctttgaccatgcgcgcgcggatgcatcgcgcaaataccctgccgaggcaacggtctcacgcacctcataggttccgtagggcaattcgtctatggcggttctcgccacgatgcccttgctccccgttggcttcccatcggagtcgactatgtctccgtaggaggcagacaatgttcgcaccacgtcgccggacttataggtgcgattgttcacgacaaccgcattggcactgcggttgatcacctcgaaaccggtgccgttcaacgaagccgcacccaatggggtcgccaaccccgtctcacgatccactttgagcaattggagcccaccgcgctgcacatcgttggcattcgcacccactccgcggatcgtggccatgttcgcgtcgacgccattggcgtcgagcgtgtaccgcacgatcatgttgtcttcgcgaatccggaaggtcttgtcgaacccagcccggtggtaaccggccgcagcactgcgttcgcgaatctgataggtgccgtatggcaggagtctcgtctccgttgcagccacactgttcccctgcaccgtcttggtggctatggtcgccaccacggcatcgcggggaatctccctgccgcccacatgaaccggcgccatggatttgttgacgatctcatacaccgtgccgtcgagcgacgcatcgccctgtggctgggaaccatgcaggtcatcatcggtcttgaccacctcgacgccgcctttgaccgtttcattcgggaatgcgatcgtggtcgcgtcgttgccgcccgagccgttgttccacgggttcagtgtagtgcgcatcaccttgtggtcgccgccgtcggtgagggtgaatacactgcccgggtgttgtgccgaagcggcacgcaccagcccttgaggtgcgttgagctcggtgatgcgcacggttcccagaggaaacatggtgcggcccgctgaatccgtgtagggccatgtgccctcatccggcttctcatgcaaccgcgcaacgccattggagtcggttcgccatatggcattcgcttgggggtgtttgccctcaagggcggctgcatcggtggccaccatgccgaaccactccacccggaaacgcaccccctctaacgacgccacatcaccttcgagggagcccggcgagccggcgttggctatgactttgcgcacgtgaaggtcatcaatggaggtcagcggcaattcggcatgttcgccatccatcgtgatggtctgcgtgcctgatccttcagcaatctccacggttttgaccttggaattcagcatgtagcctcttcgtggcgcctgcatttcctgcaacgtataggtgccgggcatcacatcgacgctcgaggtcgccctgccttcggcatcggtgctgaaggtatgcaccagcgtcccattccggcgcaatgcatactcggcaccggtcatatcgtatgcctcattggcggtggtgtatgcggcattcgtcgcgaccttacgcatcgtcaccgtccgcgggtgcgctttcttcggcaccctacgcgcatacagcatgcgttgcagggtgcctgcggttccgaccggctcatagaacacggcctcgtattcgtcgcgatcctcggcattgagggccttctgcgccagaagccacgccagaccgatcatcgtgtagggggcgaaattctgctggccgccgctcgaatagccggccccagccacctgatgccccggatttgccaccgataccgccttcgtggccttcgatgagtcctctccaccttccacacgcacctgaccggaggcgatccatattgccagctgcgtcacggaacgtgcgtcgacgtcgtcgaggttcttggcgaacacgctctgactttccacgttcgggtaccccttcgccgcgatccacgccacggcaccggtctgcggagcacctgccttgtggtattccaccgtgctgggacgggtggtgtatttgaacatgtggtaccccgtgaccggctcggccaccgtcaccgtattccgcgcgtcgccccaatggtcgcccggagcccctttgtcgacgtccatgcaataggcggcattgcctcggaagtacgcctgcgcctcttcgaattgactgttcgtgtacaccggcacggtcggattcgcctcccggaacccggagaaaccgtagcggaacgccggcagatcgttctcgctcaaattcatattggccatggagacggcgaaatgcatggtttgcgggaattcagcggattcttcggcccacgcgggtgccgcctccaccacaccgaccactgttgccacggccatgcaggccgaagccgccctcctcgccaataccgcgagcgcgctgtgcccgccatccaatcgcacgccattgtgctttcgcatgagattcctcctattcctttcctgtttccatgtgttcgtcggcgcctgcggtcgccgcgttgtgttcaccgtcttcccgtcgcagtgacatcgcatgtcgacgatgcgcgaccagtagcatggcgatggcggtcacaatcactacgcccatcagggcgacgccgcccatgctcacgcctgttctcgccagtcgaataggtgcgggctgccgtgtgacgctcttggcggggtctgttcgcactccctgttgcgtcggggaagcactgaggtcagcggtttttcgctcgtctgcgggcaacccgtctgcagccggttcggcatggacgctcccacgtaccacgcggacgcactcccagctgtcgccgtaggcgctctgctgcggcatcgcacgggcgtcacccttgaatttccagacgaacacataccacccaggacgggcggcttgcaccgtgaccgcatcgccatgcgcatcgatctggccgccgccgaatctcacgatgccgttgcgcgcgggcacgtcccagctgccgatcagcgtgtggtgtccgtcttcctccggctcggcctcgccttgcggccggtacggttcgtcgtcaccgccattgccgtcgcccgcccaccacatgcttacctgggcgtacggttcgtcggcagccagcccgtactgttcgttgcctccgaactcaccgtggtcatgggggaatccgctcacttcgatcacgtcggtcagcatggcgcccacgtgtgcactgtgttcaccggcctgtgaccgcacctgcacaggcgtgcgggtcacattggtctccgccggctccatgaacccgctcacccaatcatgagtcatcacctgttgcacggcggatggttgccgttgccgttccaccgcccacacccatgtgccgtaggcgtcgccgtcatgtgctcggtacggctccgtcccgttctcctcgctgacggcctgcacctgcctatgctgcccgtcatgggtgaacgtcgcgttgccgtatgcggcgggttcgaatccgagccgtttcagtctgcctaggaattcccgtgccggttcgccggaatccgggcgtatgaccgagtccaagttctccccgcgcaggccggtgaagtaccacccgctcgcctccactgcggaatcggcaggccagtagttgtcgtcaccgtcgagtcgcatggtcacgtcatcggtcaccgcagacccgggatctgtggatttcggcgtggtctgggtgaccaacgtcggcgagaacacggtgaccgtgtcgaatgccgtcccggccgcttccaccgtcttggccgcagccacgcgcaacaggttctgggagctcacggccatctccaccgccggcacctgcatctgcgcatggacgcgcacagctccttcgccgctcgccttccatgcgaagcggagggtcttgccgttggtgcgcccgattcgcgttctcgcaccgttcgcgaacacggcatcgccctccagactcaccgaatactccgtgttcgtggtgggcgtgccctcgtcgtcgagaatctcgagcacgatgtttcccgcgcgtttgccgtcggtgtactcgactcgggtcgcaatggactgcggcacgaccggacgcacctcctcatagagctcgcgcgccttggcgagtatgttcgggtattggctttcgagaatccctctcgcatgcggccaaccggcatctccctggcttgtgtcgaatgcatcgtgcacgatgaacgccaacgccgcctgcagatcgtcgacgttgtgttcgcgttggtgtcggttgagcatctcgcccaccaggcgcgtcaccaacgtgtccggcatcggtttggtgacgccgagcgtgtagttcgtctcctgcgattgatccatgcagtagtaccgtctctgctggccgtcatatccgatcattccgaagaaatagattcggccgccatcgaagtagctttggtagtctgaggcgctggccacggtgagtttctcccctgtgtacgcattggcacgagtcgcaccccgtatgccgacaatcgcgcatacggccgccagcatggcgagcagccgcaccaccacgacccgcatatgtcttgccgatctgttcattccaaccgtccttcccgtattgtgttggcagattatgtgctgtcagattcacacagtcaggtcggcgtgcatagccggacggggcattgtggacggaggacggcgtttcagtcgattgtggataaccgcgccactattcacaatccacaacgcctatgcgacaacggcacgaactttgtccatcccgcattgaattcatgcgggaacgaagaggcctgcggccttccgaccggaaatgcatccacaatgtggactattggtaaggaatttccaccgtttgtacaggctcgcaacctcagccgcgaaaaactccatacaatgacaggtatggaagcacaacacaatgagacagaggccgccgggaaaccggcggcgaagaaaacgacgcgcacgcgcaagccacgcgcgtccaagcaggccacattcatagccgaggcaccggccatgccgatcgccatcaaggagccgggccagttcggacgcgtcaacatcctgaactgccaaccgtccgtcgaagacgacgtctacgctgcccgagtcgagatcggggagcagttcaccgtttccgcccaggtgttcatggaggggcgcacgaaggtcggagcgaccgccgtgctgaagaatccacgcggccgcatcatggcacgggtcccgatgaccgtggagaacgcaggcctcgacctgtacacggcgaagctgcaggctggcgagcattccacgctgaacccgtgggatgccgaattcgcagaggtgaagaagcagctgggcaactggcgcgtggccatcgaaggttgggaagacacctacggggcatggttgcatgacgcccgcatcaaggtggatgtactttccgacgtggagaacaccctgaccagcggatccgagctgctcacccgctgggcctccacccgtgacgcgaatctcaacgccgagcagcgcaagacgttgcgcgaggcagcgaaatcgatgatggacacgtcgctcgacgccaaaagccggctcaccttcgccgacaacgccgacatcgaggcactgcatgagacgaatccgctgcgcgacggtctcacctcaagtggtgaccatgtgttccacgtggaacgcccgaagtcgagcttcagcgcctggtaccagttcttcccgcgttccgagggcgcctacctcgacgacaacggcaaaaaggtgcagggcaacttccacacggccgtcagcggactggaacgagccaaggcggagggcttcaacatcgtgtacctgcctccgatcttcccgatcggcgtgacgaaccgcaagggccccgacggtgccctcaatgcgggcccggacgacccaggctcgccgttcggcattggcagcgaactcggtggacacgacaccgtcgacccactgctcggcacgatggatgacttcaaggcgttctgccagcgcgcccacgagctgaacctcgaagtggcgctcgacttcgccttgcagtgctcaccggaccacccgtgggtgaaggagcatccgaactggttccgcaccaagccggacggttcgatcgcctacgccgagaacccgccgaagaaataccaggacatctatccgatcgacttcgacaacgatctcgagggtatcgagcgtgaggtcgaacgcatcatgaacctgtggatcgacgcgggcgtaaccatcttccgcgtcgacaaccctcacaccaagccggtgcgcttctggcaggacgtgatcgcagccgtgacgaagaagcacccagaggtgctgttcctcgccgaggccttcacgcgcccggccatggtgcgcgcgctgagctacgccggtttcacgcagtcccactgctatttcccgtggcgcaacacgaagccgcagctcgaggagttcctgcaggagaccaacggcaagggcggctactaccagcacaacacgttctggcccaccacccccgacatcctcaccgcctatgtgcgcgacggcggtgtggcggcacacgccatccgcgccgtgctcgcggccctcggctcccccagctggggcatctacaacggctatgagcttatcgagaaccggcagcgcgccgatgccgaggagcagtcgtcgaacgagaagttcgagatcaaggtccgcgactggtccgcggcgaacagaatcggcatctccaaactgctcacctcgctcaacgagatccgctcgaagcatgcggccaccacgagctaccacaatctgacgatcctgccgtccgccaacgagaacatcatcgccttcgcacggcagacggaaggccgcttcaccaaagacggacgcaccgacacgctcatcgttgtggtcaatctcgacccatacaacgagcagcagtcgtcgatccacgtcgatgccaaagcactcgggctgcccaccgagcacccgtaccgcgtgaaggaccagctcaccggccgtgagtacgactggagctgggacaacttcgtctcgctggcaccctgggcggatgtggcgcatgtgttccacgtagagaccggggaacagccgctcgactgagagcaccgctgagcacacgggggccgttcgccgcatgcaactcgcgacgaacggcccccgtgtgcatgtgcgggtattgtgttgttcgttagcacaagtccatgcaaaggagaaataccatggcagaaaccttcaatgtcgtcgtggagatcccacgcggttccaagaacaagtacgaagtggaccaggcctccggccgcgtgttcctcgaccgcacgctgttcacggcgatgggctacccggatgactacggctatatcgacggcacgctgggcgaagacggcgacccgctcgacgcgctggtgatgctcaccgactctgtgttcccgggctgcgtggtcaagtgccgcgccgtcggcctgtaccacatggtcgacgaggaaggcggcgacgacaaggtgctgtgcgttccggacgacgtccgttatgacaacatcaagaacatcgacgacgtctccaagttccacaaggcggagatcaagcacttcttcgagcagtacaaggctctcgagccgggcaaggaggtcatgcccggggacttcttcgccgacgtcgagaccgccgagaaggaaatcaaggaagccaaggagcgtctcgccaagtccaagaacgaagacatcacgctctgaaatccagacgcgcatgtgaatggcgatgggggccggtccatatggaccggcccccatcgccattcacatgctgcaggcgtctgcggccgtctgcgatctcacaccgtgagcgtgagctgcacgaccagcgtggcgagcgcgaccagaccaccggtgagcatcaccggtatcaacgcgaagcccacccaaggagcctgcgcgccctcgagcggccgcgaatcgcgataccatacgcgatccatgaatccaagaccgacggcgaacaccacaatggccaccacaccggcaatccacacccacaattcgccattcgcgctctccgccttgctttcgccgaagccctgcatgagcatcggcaggaagcaccatccgctgcacagcaccgtgcatgcgccgtccatcaccatatgcgacaactgcacaatcaagtggctgcggtcgaggcgagccatctgcctgccgaacgcgacgaccacgagcacgacgagcaacgcgcccacgccggcgaaccatgcgcacaccgccaacgtacccggcgaacccaattgcgggcgggagggcgaacccatcgagccgaacacgaactcgccaagcatgggcgtggaggcgaagatcatgccgagcaatccgagaatcacaccggtgacacggccgggaattccgtcgcgcagcggcgtgaagaacgcaaacagcatgatcatgacacccactacaaagccggtcagcgagaacatgaccgacgagacggcattgctgccgggaatgcatgcgagcgcgacgagcaccacgtagagtgcaatctgcaaccatacggaccgcgagaacggagccaccggcgccacagggcggtaatccggggccatctgcgcggtcagggtggaatccgcggtcagttcgccgtccgccgcggcattgcgggcgtcgttaccatgttgtgtctcactcatctctcaccttcatatctccaccgtcacacgcatacatccacgcaggcggtcacaccaagaaacagtgtaatatggggccattcccgcccacaaatcggcccagcagccgcactcgtcgcccgtcgcgatgggcgcgcgtccggcacgacgtcccattttcggtttctcatcgcgaaatggtcgcagggttttttcgtcgcttccgctacactgacagcaaaacgtgcttgcacacaccatgcgcacatcgctgttacacaagcatggaacccaacaggagaggatcgggaacgtgacggatttgactttgatgacgttttccacggatccaaccaccgtgctgccgtcgctcaccctgctctcccaccgtgtgcgcgtattgcctatggacgcctcgagtctggtgcgcatgcccgagaacacgattctgctgctcgacgcacgcgacgacctggcctccgcgaaaacactgtgcaggctgctgcacgcctcgggtctgtcgacgccgatcgtgctcattctcaccgagggcggcttcaccgtggtcaacggcgaatggggggtgagcgacgtgatcgtgaacaccgcatcgccggccgaggtcgaagggcgtctgcgtctggtcaccgaacgcgtggccacgtataacgtgatgccgaatgcactggcgaattccggcccggaggacgaggacggactcatccgctccggcgaccttgtggtggatacgaacggctacaccgcgaatctgcgcggcgtgcccatcgacttggcatacaaggagttcgagctgctcaaatacctcgtccagcaccccggtcgcgtgttcacgcgagcgcagctgctgcaggaggtttggggttatgactactacggcggcacgcgcaccgtcgacgtgcatgtgcggcgcctgcgtgcaaagctcggcggcgaatacgaacatctgatcggcaccgtgcgcaacgtcggctaccgcttcgacccgcccgaagaggaatctgcgaacaacaccgcccgtgaagctgccgagatgggctcacctacctcggcggacgaataattcccctcttccggttaccctacccttagggacgtgcgaattcgcatggaacctaacagtcgaggattgcgggagcggtatggccggtgaaagcaggaaagcgcgcatcacacgcatgcacaggcagtatgagaccctgtgcgagttcattccgacggtgaaatgccagctggatttccatacgccctttgagctgctggtcgcgacgattctgagcgcacagaccaccgacaagcgcgtcaattcgatcacgccggagctcttcggcacctaccccaccgccgcggcgctcgccgacgcccgcttggaggacgtcgagagcattattcgcccgcttggcttctaccatgtgaaggccgagcacatcattgccgtggcacggcagattgtggaacgattcggcgggcagataccgcagacaatggaggagctcacgtcgctgcccggcgtgggccgcaaaaccgcgaacgtcgtgcttggcaacgcgttccgcgttcccggattccccgtagacacccatgtgatccgtgtgaccgggcgcctgcattggcgtgatgactggatgaagacgagcacgacccccgaacgcatcgagcaggagatcaccggctgcttccccgaaagcgaatggaccgacctgtcgcaccggctcatcatcttcggccgcaacatctgcacgagccgcagtcccgaatgcgagaactgcccactgctgcccacctgcccgagcgccggcgagttcctcgaaatcgccgccgagcgcaaggcgcgcgccacgcggcgcgcccccaggaagccgcgttcgcgcaaaaccgccaagtgaccgggcgtgtccagcacgcgaattcaacacgcgaagacagctacgactccagcgtgcgaagccaacgcgcgaatccagcccgcaaagccagcacgcaaagccagcacgaatccaccgcggatccagctgcgtaaaaggggacagatacccatgcaaatccgtcccttttacgcaggaggtttaatctatccgtgcagcgggtcttcgatttgcaacctccaatccccccaatctgcgaccctcaattcccaatctgcaatcttcaatctgcgtaaaaaggctcttctcaggttagtgtgtaagggccgtgtttcctcattcaatttttctatcacacaagcaatgatgaagcacggcccttacacactaacctgagaagagcccgtaaaaagggacgtttatgtgcgtgatttgtctctttttacgcagatgtttgcgttgttgatgcagctgatgcagctgatgcaactgatgatgcgcaatgacctgtctgcgtaaaaggagacagattgcatggatacctgtctccttgtacgcagggtgggcagagaggcgcgccggattatctatactggagccatgactgagcacggcaacaggcgcgcacgcaagattcgcccctggattgtattcttcgtcatcatcgccgtgcttggcgcggcggccggcgtgggcatcaccggactgcgcggcggcaacagcggcctcaacgccgtggttgggtcgctgcgcggcggccgcaaactcgaagtgggactcctcgacgagcccacgtcgctcgacattcggtccaacagcgaacgttcggtgcagcaggcactcatgggcaatgtatacgagacgcttgtcaccttcaacgacgagcaggcaatcgcttccggactggccgcccgctggacgcagaccaccgacggactgcgctacacgttcttcctgcgcaacgggctcacattctcggatggcacgccgctggacgccagctcggtggtgcgctcgctccagcagacgctcgccggcgaccacacgaacgacgggctctcgaacatcacggccgtggagaacaacgacgcgcgatcagtcacgttcacgctctcctcgccgaacccgcgcctcttgcccgcactggcgagccaagccggcgccatcgtgaacccgaatgcgaagaaccccgatttcgcacaccattcctacggctccggcccgttcatcgtgaacgcggtgcagccgggttccatcgagctcacccgcaacgaacactattgggcagacaagccgaagacctcgcaggcgacgctgcgctattacacggacgagcagaagatggccgacgacctcaaagccggcaagctcaacgtggcgctcccccgttcggcccacattgccgaacagctctcccacacgtccggcatcacactgcaagacggtttcagcacgcgcaagactctgctggcgctcaacagcaagagcgagagcccattctccgatgagcaggtgcgccagttcacacgctatgccattgacgcacggcagatcgcgaatgccgagccgggtgccaaagcccagctgagcgggccgatctcgcagatgcagcccggctatgtggacctcgacaatctgttccagcatgacctcggcaaggcttcgtcgatgcgctggtatttcgccgcagattacttcaaaccgttcaatttgctcgccgatgaggcgcaccgcgagctcgcccagacgctggtggaccagatcgccgcgattccgatgccggtttcgttggaagtggtcgattcggccacgctgaacagtcgcgtgcagtccggcgactacacctgcgcgctgatcgagatggacgatccgcacgattacacgcggttcgtcgacggcagcgcaatgttcggctatgtgaacggaaccgtgcagcagcagtaccgcaaggcgctcgaacaaaccgatttcaaggactaccgcgaacagttgcgcgaattcgaccgcctggtgagcgatgatgccgcgagcgcgtggctgtacacgggcaaggattatgtggccgcgcagaacgacgtgcagggtgtggacgcgaatctggcgggctccagacttgcgctcgcccagctgagctagcgcggccgcggaacggcggcggaaacgcatatgttgtcagcgtagctttttagacttctttctatgacagatagcgaagattattcgatcaacgccaatctcaccgcactccccgaccgtgtgggcgtggacggccttgaagccaagtggcgcaaggtctgggatgaggatggcacgtacacgttccacgatccaggcgagcgcaaggccgtctattccatcgacaccccgccacccaccgtctcggggcacctgcacgtcggtcacgtgttctcgtacacgcacaccgacatcatcgcccggttcaagcgcatgaacggctatgaggtgctctacccgatgggttgggacgacaacggcctgcccaccgagcgccgtgtgcagaactactacggtgtgcgcgtcgacacttcgctcaagtacgacccggatttcgtgccgccgttcgagggcaccgagggcaagaagatccaggccaaggaccaggtgccgatctcgcgcaagaatttcattgaactgtgcgagaagctcactgcgcaggatgagaagcagttcgaggaactctggcgtcagctgggcctgtcgatcgattggaaacagacctatcacaccattggcgagtacccgcagcgcgtggcccagaaggcattcctgcgcaatctggaacgcggtgaggcctaccagaaggatgccccgggcctgtgggacgtcacgttccagaccgccgtggcccaggccgagctcgaatcgcgcgaatacccgggcttctaccatcgcattgcgttccgcttcgaggagaccggcgagccgatctacatcgagaccacccgtcccgagctgctgccggcctgcgtggcgctcatcgcgcacccggatgacgagcggtacaagccgtatttcggcaagatggtcacctctccgctgttcaacgtgaaggttcccgtgctcgcccacccggccgccgagaaagacaagggcgccggcatcgccatgtgctgtacgttcggcgacatgaccgacgtcgaatggtggcgtgacctgcacctgccgacccgctcgatcattcagcgcaacggccgcattgtcatggacaccccggactggatccatgacgagaagggccgccagtatttcgcgggtcttgcaggcaagaccacgttctcggcccgcaagcagatcgtggaggacctgcaggagaccggcgacatggacggcgaaccgaagccgaccatgcgtatgacgaacttctacgagaagggcgacaagccgctcgagatcgtcacatcccgccagtggtacctcgagaacggcggcaccaacaaggccctcaacaccgagctcatcgagcgcggcaaggagctcaacttccaccccgacttcatgcgcgtgcgctacgaaaactgggtgcatggcctcaacggcgactggctcatctcgcgccagcgcttcttcggcgtgccgttcccgctgtggtacccgctcgacgccaacggggaaccggattacagcaacccgctcaccccgagcgaggatcgtctgccgatcgacccgaccatcgatgtgccggaggggtacggcgaggaccagcgtgaccagccgaacggcttcatggccgaacccgacatcatggacacctgggccacgtcgtcgctcaccccgcagatcgtgacgaagtgggccgagcccggcgaggagaacgagcggttcttcaagtccacgttcccgatggatttgcgcccgcagggccaggacatcattcgcacctggctgttcagcacgatcgaccgcgccgacctcgagaaccattgcctgccgtgggccaacgccacgctgtccggctggattctcgacccggaccacaagaagatgtcgaaatccaagggcaacgtcgtggtgccgaacaagccgatcgagcagttcggcgcggacgccgtgcgctactgggcggcatcggcgcgcctcggcctcgacgccacgtatgacgaagggcagatgaagatcggccgccgcctggccatcaagctgctcaatgccacgaagttcgccttggcgatcggtcgtgaggacgagaaccaccacgtgggcgagggcgccacggccagctgggatccgaaggacgtcaccgagccgctcgaccgcgccgcgatggcgaagatggcgaaggtggtctacgatgcgaccgaatcgctcaacaactacgagcattcaaaggcgctggagacgattgaggacttcttctggcagttctgcgacgactatatcgaactcgtgaagaaccgcgcctatggcaccgccgaatccacaggagttgagcccagcccgcaggccgtgaagtccgcacgcaccacgctcggactcggactcgacgcattcgcacgcctgttggcaccgttcctgccctacaccactgaagaggtgtggagctggatgcacgccggcgaaggctccgtgcaccatgcgccatggccgaagcccatcacttacgccaccgccgcgttcaaggcctcgccggagctgctcacgcaggccggagccgcactcaccgcactgcgtggcatcaagtcgaaggccaaggtctcgatgaagacgccgatcctctcggtgatgctcaacgtgaacgacgagctgcacgacgccctggcgccggcccttggcgacatcgccgaggcggcacgcgtcaccggccgcatctcactgcagaaggccagcgacctcatggcgaagttcgcccgtccgaagggcgagggcacggcagcaccgggcccggcatcggacgagacggacgtcgaggagatcaccgtggtcgaaagcgagctcggcgagccaccggtcaagaaaccgaaggccgcgcagtaagcgcgaatccgggaaacgaaatgcgggaaggcatgagcatgtgcctcccgcatttcgttttccggcggcggcatgcaagggaccatctcctattcgtcggaaattaatgggcaggttgttcgtctcgcgtataggctttgggcgaatacaaaaaagttgtcggggtcttaaactcattgatgaacgtattttctatctgttggaaaagaacgagaccatgactagcacgcataccaccacagagcgccgttatgttgatgggcgcactctcgatgaaaaagacaatattattctcgacattctcgaacacaatggccgtgccacactggcacagcttgcggaggcggcttcactatccatctcggccacacagtcgcgtgtgcagaagctcgagaaaaacggcgtcatcgtcggctaccgtgcgatcatccattacccggaacagaccactggaaccatccacgcattcgtgtcggtgacgccactcgaatacgacgagaacgcgaacattccggagaaactcgaacacatcagcggcatcgattcgtgcgatgccgtctccggctcccaggtgtatgtgcttaccgtcaccgtgcccaccgtcccgcagcttgaggacctcgtgaccaagatccaccgcatcgtgccgtcgaacgtggagacgacgatggtgttgcaccgctatttcccgcgctgactgccccggtcccatatgctctcgttcggtagtcacagcacgctactgtagagatatgagcgaagagcatatggaacaaggcgcctccggctccaatgagacggtgatcgattccgagcaggactggcgcgacgaacgcacgcgagacatcgtggacaaaatagagaccctgcgacagtcaatcgacaacgtggacatggcaatcgtcgcattgctcgcggaacgcttcaaatacacctcttcagtgggtgtgctcaaggcacgcgcaggattcgcacccgccgactacaaacgcgaggaagagcagatgcgccgtctgcgccgactcgcaatcgacgcgggactcgacccagagattgccgaggaataccgcgaattcgtggtcaccgaagccaagaaacggcataagcgcatcgccgaaaccggcgaggatccgggcgtgctcgacatcttcgcctgatacttccccaccacaacaccgccgtgaaacactcatcatcaccacaccacgccaaaccatctgcagccaaggccgtgctcactgctggactcgcagccgcattgtgcgccgcgctcaccatgcccgcgctcacgagcacgcatgcagaccagcccgccacaacgaatgtggagggtctggcggcccggttcaccgacgacgatctgttcatggtgaacagcgccgcggattcgtcacgccgcatgtacgcggtgtcgcggaacgggacgtcgcatatgcagctcgacggctcgctgccgttcaccctcgacgtcagctacacgctcaacgggccgaatgtgccggtcgacagactgaacaacgcaagtggcatggtgggcgtgcacgtcgtggcacgagtgaacgaccgggccggcgacggcatgcagcggctcggtcgccagatgcgcccgttcgccttcctctccataccgagtgcggcagtgggcgacatctcggcctccgacggcgtggtcgtgcaacgcgacggttcggccatcaccatcgccgcgaccgcggagccgggttctacgcttgacttccacgtgtatgccgacgccaaacgtttctcgatgagcccggtggcgctcgccgtgctcccgcaatccgcgccgaccggctacactgcgcagctgcagtcattggctcggaattcgaccaccttggtcaattcgatcaccggcgagaacaacgacgatgcgaatgcgagactcatcggcgaactcgaacgattgcgcgagcaggaacgcgtgctggcacagcagcagatcgcgcaggccgatgccgcgcacaaacgcgcattccacgaatacatggcggcatacgtcagctcatataccgcgcatctgagcggttctgtgggcaattccacccagttgacggcgctcatgggcaccgcgggcgagctgaacggagacacacccctggcgcgggcggtcacgaatctggcgagcgcggtcaatgcgcgcagtgacgcctaccagcacaccggtgcggcagacgaggtcgactggatcatccggcgcatcagacaacgcggcacgcaggggctgacggccgagctctcccagcgtgccggcatgaactcccgcgatggcgcgcagaactacgcggcggggcagaaacagctgtcgagcgcgatgattccgtattcgatggcgtatacggatgcgtatacggagaatctcaatgcactgaccggcggcgatgtctcgcgcgcgcaggctatgggtgcgcaggccattgcgcagacagacgcgcagttcggttcgaacagcacgctcaccagcgaccagaccaaggtggatgcggcgatgaacgagctggcacaggcgcgcgagcgcaccggtgcctcgagcgccgaccggcagattgccttgcggtacgccgaccgtttctcaaatgcagctgccaacgcctctggggccgcgcagaacgctggcttgggcacgccagtctccgcaatcgcatcgcaggtgtacgacggctggctcgaacattcgatcggcgggaagatcgtcggggcgcgcaccaaggcgattgccgatgcgcaggccaaggaacgtcgccagcaaggcgacgacgctcaggcgggagcgtcgctcgtcgtggcgtccgatgacgatgccgccgctgacgtgagcaaattcgccggctctgcagccgctggactcggtgtgaagggcggcggagcgaaggacgatgccgcgcatcacagcagtgatgccggtggcagcggcaccccgcatcgcgagcgcgttcccgaaagcgagcgcttggccacgcagttcggcgtctccgatcttgccagcggcctcgtgctgcatgccgacccctcgcaggtcgttgacgagaccgtgatcatcgggcaagcgcagccgttgcttgaggcgggagccgcaatgagcgggccatcgggcggcctggcatcgcagttggcgcacgacactgcggaccactggccgaatctgcgtctgctgctcgtgcgccccacactgtgagtcgattcttgagcacaacgcgattggcctccgacgacccttctgggcacgtcggaggccaatcgcgtatatgaacggggctatgccgtcagttgttcgagccgccgttcagcgagctgttgccctgttgcacgatcgctttgaagaagtctgcattcgtcatcgtcttcttcaggcgcggcacgagcgtctgataggcctgctcgggctccaggccgccaagcaggcgacgcaggctgtacaacaccggaagttcctgcgggttcgtgatgagctcctcacggcgggtgccggaagcattgatgtccacagccgggaacaggcgcttgtcggccagttcgcgactcagacgcagctccatgttgccggtgcccttgaactcctcgaagatcacctcgtccatcttcgaaccggtctccaccagggccgacgagatgatggtgagcgaaccgccgttttcgatgttgcgggcggcaccgaagaacttcttcggcgggtagagtgcctgggcgtccacaccaccggagaggatgcgccctgaggcaggtgccgcgatgttgtaggcacgggcgaggcgcgtcatggaatcgagcagcaccaccacgtcctgccccagctccaccaggcgcttggcgcgttcgatggcgagctcggcgacgatggtatggtcggaggccgggcggtcgaaggtggacgagatgatctcacccttcacggtgcgctccatgtcggtgacctcttccgggcgttcatcgacgagcacgaccatgaggtgcacctcgggattgttcacagcgatcgcattggcgatgttctgcagcgtgatcgtcttgccagctttcggcggagagacgatcaggccgcgctggcccttgccgatcggcgaaacgatgtcgatcaggcggccgatgatgcggttcggcgtggtctccatacgcaggcgctcgtcggggtacaacggcgtgagcttgctgaagttcgggcgatcctgtgcctcttccacgcttaggccgttgatgagcgtgatcgactgcaacggcatgaacttctgacgctggttgcggcgctcgccctcatggggcgcacgcgtgtaaccgcgcacggcatcgcctttgcgcaggccgtacttcttgatctgccccatcgacacatagatgtcgttcggtccgggcaggtacccggaagtgcgaatgaacgcgtaggaatcgagcacgtcgacgatgccgccgacctccacgagatcctcggtgttctcctcgcgacgctcattgcggtcgttgcgattgttgcgctcattgcgattattgccacgttcgtcgcgggaacggcgttcgttgccctcctcacgctcctcgtagtcacgttcgttgcggttcctgcggtgctggcggttctccctgtcggcacgcgcatttgaacggtcgttggtgcggcttccgcgctcgccacggcgatgcgcatgctcctcgtgacgttcgtcactctcgtcgtcattcgcactcagcggcaatgacgagagaatgtcgtctagatccggcttggcttccgcatccggttcacgcacggccgccgctcctgcacgccgccgcgtgggcagtgagtccacggcaccgcgacggcgacgtggctgctcaccgccgcgctctgcgtgctcgggcagattcagcgtgctcagcagctgctcggcggcggacgtctcaccattggtcgcagcctgatccgcagattccatctgacggcgcttcccgcgcacgcggcgaccgcgaatctgggtcatctcctcttcggcgggcagggcggcatggccctcctccttcacctgggtaggctgttcggcagcagactcctcgactgcctttggctcgccggccttgcgcaccacgcgtcgggcaccggtcttgcgaaccggaacggagactgcatcatcgtgccctgcgggctgttccgcctgtgccggtgccgtttcgctcttcgccgacgactgcttggcgcgggcctcttcgatcgctgccaccaagtcgcccttgcgcttcgcagaaagaccgcgcaagccaagttccttggcgatctccttgagctcaggcagcttcatcttacttaaatcttggctatcggccacgttgttgtaccttccctaggccatacgcataccagcgcgctatggcagaaaaagaaattgaaccgcatacacgggttcgtgtgaatgaatacacacacggtacctcaatatcgagacgaaatgcgtgtggcgcccatgttgtgaacatgggcgccacacgcgaacgcaggtatctgcttgtattttatggaaccatcacttggattcgtgatacgacttgtcggtgttcaccgaccacacgttgttcttcgaggtcttgtgggtgcgaatgttgtccaccgcctccatcgacgtggccatcgaatggtccatgttgttgtagcggtgctgtccgttgcgacccacacagtacagattaccgaacgaatcaaggtattccacgagctcgggcatctggtcgtaggtgtcgaagtaggccgggtatgccttcttcacacgctcgcggtgcgagtcgagcacgtcgtccgggcctgcgatgacgcccatgcgggtgagttcgtgaatggcgaacttcgtggcgtcttcgtcgctcatgttccagaactcatcgccttcctcgcagaagtattcgaggccgatccacaccgtgtcgtccacgtccttcaccaggtatgggctccaattattgaagatctgcaggcgaccaaccttgtagcccgggtcctgcacgtaaatccagcagtccggtacaatcggcggattgcccagcgtcgggatgtcggtggtgttcttgagcttcaaatgcttgaccagcaggccgaccgtgacgaaatcgcggtatggcaggccttcggcaatatggcgcatgtcggacggcacaggctgctgctcggtgtccatggcctcgaccaggtccttcaccggcatcgacgagatgaactggtcggcctcgagggtctcctgcgtgccatcggaatgcctcacgagcaccgaggcgattcggccgtcggcaccacgattcacaccgaccaccttggcatcggtcttcaccttgaccccacgggcctcgcaattgtctttcaccgtctcccacagctgccccggcccgagcttggggtaccagaactcctcgatgagcgaagtctccacctcgctgttgtcgcgctgcttcggcatcagcttctgcacggcattcttgagcacctcggagatcgagaggcccttgacgcgctgcgaaccccaatccgccgaaatcaccgaggggtgacgcccccacagtttctcggtgtagccttcgaagaacatcgaatagagcacgcgcccgaaccggttgatgtagaagttctccagattgtcttccggaagtttgtgcaccatcgacttcaggtacgagaaaccggccttcatggtaatcttcgggcccatcgccttgagcgtatcgagcgacagcgagattgggtagtcgaggaagtgcttgttccagtagatgcgcgagacacgatggcgcttgagcatcactttgtcttcaatctcagggtccggtccgccaggctccagatcatgggtgtcgcggccgagtttcttgtcgtcgtatgacggagccccctgcaacggcagcgtctcctgccaccagtccatgatgcgctcgtccttcgagaagaagcggtggccaccgatgtccatgcggttgccatcgtgcttcacggtacgggcgatgccgccgaattcctcggattcctcgagcagcgtcacatcataggcgttcgaaccgtccttcaccagctcccatgctgcggtgagaccggcagggcctccaccaatgatgacgaccgattctggttcgttcgtggtcacgatgagatcctccttcattgagggtatgcatattgcaaggacgatcggggaacgccctgcctgaatcattcaagtcaaaccgtaaagccgttaccagtctagtgcgtgccatgacctaggcatgcgctcataccgttgtgagtggacatcgcggccgcacatgcccgaatggcatgctgcagtgcgcgaacggccgtcattgcatgtcttcgggtatgtcgatgtcggtctgctgcacctcttcgacgttgacgtccttgaacgtcacgatgcgcacgttcttcacgaaacgactggaacggtatacatcccacacccacgcatcggagagctgcacatcgaaatacacgtcctgtccggcggaccgcacgttgaaatcgaccttgttcgccaagtagaagcgtcgttccgtctccaccacgtacttgaacagcttgatcacgtcacggtactcgcggtacagcgcgagctcggcatcggtttcgtagttgtcgagatcttcggcactcatgcttgaagttactcttcctgttgagaatcgttggcattgcgcgacgacatgcggtcatgaccgagtcggcgccaccatgccttcttcgatttgttgcgttccgtactgttgtacggccacgtattctccgactcgatgttgtcctgtgcgatgcgagcggagtcggacttcatcttgtcgcccatggttgtctcgtcttgcgcctcgtcactgtgtgcctccggctgcgaggcgatggtgtcagacagtgcctgcttgcggattgcggtggaatgctggtggagcagcaacgccttctccatgccgggattcgtggtgatcacgtgcatgccgaaggcgtccatggcacgaaccgggtcgtactcgtcgaccaacgtgtcaagcacgttgagatcctggtacttgttgttggcctcgtcccacaaggcgtcgcgcgaggtgccggacggcacgaaccccagcgactggtacaccgagtaggaacgggtgttcttctcgggcaccgccacccagatgcggtggagtccaaggccttcgggttcgtcggcgaaaccatatgtcatcacgcgcggcatcgcatcacgagaatagccgcgaccgcggtattccttgcccagaatcacctggatgcgggcggagcgcgcccaaccgtcgatgtcgatgaggaagatcatgccaatgaactcggtggcggtgtgctcgttgacggtctcatcctcatgctcctcgggaacggtgagcatcgcccatgcgatggtgcggcgcgattccgggtcaccgatgccggatttccgggactcgatgccgtcgacccacgcctgtgaacggcgcacccaggcctgcacggcggcgcgttccgccacgcggtcctttcccgtcacaccggaggcgttcacgtaggcgtccaatgcgtccatggatgccaagtcgcccaccgaagccggtcgcaggtacaccatctcgccctgtatgcacgggattgtgatctgcgatggcaattcacgcgagcgtgcggtaccttcccccgagtctccgtccactactgctgtcatgtcgtttccatccttgtatatgggcatccccatctttcaacctttatatgttaccctagcgccttgtctgaggcaacgccctcactcttgcgaactatttcgcccatcacaccgcccccatgcgtacaaatcttccgtgccttccgcgtcttccgtatcttccgtgtcttccgataatctgcgtaaaaagagacagatgcatgcgtcgaatcgtccctttttacacaggattcctttacgcgaggatcgatttacgtaaaaagagacaagcacgtgcgatcaaccgtccccttttacgcagagattctctgttatgcagagattccctttcgcagaagaccgggtgcagggtggaacgcagaaggcgcagcggaggccattgaggccgccgctgcgccttacggtgtctgtagtcgggtgagactcagcccttgatcttctccatgacgatcttggtgaccgccttggcatcggcctggcccttcgtggcgcgcatgaccgcgccgatgatggcgcccatcggcttcatgttgccgctcctgagcttctccaccacatccgggttggccgccatggcctcatcgacggccgtctgcagcatgccatcgtcggagacgaccttgaaaccgtgcttctccacgatctcggcaggggtgccctcgcccttgagcacgagtgcgaccgtctgcttggcgagcttgtcgttgagcttgccctcggcgatgagcttctccacatcggccacttcctgcgcgttgatcggcagctcctcgagcgagatgcccttggcgttcgcctcgcgggagagctcgccgagccaccacttcttggcaccggcaggcgacgcaccgagcttcaccgtctcctcgatgaggtcgagcgcatcggcgttgatcacgtcgcgcatctccacatcgctgaacttccattcggccttgaggcggttgcggcgctcacgcggcatttccggcatctcggccttgaggcgttcaatgtgctccggggtgatgtgcagcatcaccagatccgggtccgggaagtaccggtaatcgtcggcgtccgacttcacacggccgccggcggtggcctgcgaggcctcgtcccagtggcgcgtctcctgcaggatctcgccgccgtcgttcagaatggcggcctgacggcgaatctcatactggaccgtacgttcgatgccgcggaacgagttcacgttcttcgtttcggaacgggtgccgaatggatcgtcgggggaacggcgcagcgagacgttcacgtccgcacgcatattgccctgctccatgcgggcatgcgagatgttgagcgcacgcacgatgtcacggatggcacgcatgtatgcacctgcgatttccgggccgcggtcgccaacgccggtgatcggcttcgtcacgatctcgatgagcggcacgcccgcgcggttgtagtcgacgagcgaatggtcggcgccttcgatgcggccgtcggcgccgcccacatgcgtgttcttgccggcgtcgtcttcaatgtgcgcgcgctcgatcggcacgcggaacacggagccgtcttcgagctcgacatcgaggtagccttcgccgttcgtcggcttgtcgtactgcgagatctggtagtcacgcggcatatccgggtagaagtagttcttgcgggagaactggctccactcgttgatctggcagtgcagggccagaccgagcttgatcgcgtagtccaccgcggtggcattgagcaccggcagcgaacccggcaaaccgaggctcaccggcgtgagctcagtgttcggctcggcgccgaacgagatgggtgccgggcagaacagcttggtgcgtgtgctcagctcaacgtgggtttccaaaccgataaccgggtcgaattccttgacggcttcggaatacttcatcaacttttcagccataatctaactttcctccgccttcagtcgttgatcgaatcgagccatggggtcttcagcgacttgaagatcggcccgttccactcatcttccagcgcggcctccaatgcggcggccggcttgtacatcacttcgtcgcgctgctgcggggcgatgaactggatgcccaccggcagaccgtcgtccgacaggccggccgggatgctcatggcgggcacgccggcgaggttggccggaatggtggcgatgtcgttcatgtacatggccagcgggtcgtccattttctcaccgaacttgaacgcggtgctcgggctcgtcggggagatgagcacatcggcctgcttgaaggcgttctcgaagtcctcgatgatgagcgtgcgcaccttctgcgcggagccgtaccatgcgtcgtaatagcctgcggacagcgcataggtgcccaggatgatgcggcgcttgacttcgtcgccgaagccggcctcacgggtgtaggccatcatgttggccgccgtctgcgccacatccttcgggggcatcacgcgcaggccatagcgcatgccgtcgtagcgggcgagattcgagctcacctccgacggcatgatgatgtaataggcgcccagagcgtacttgaagcgcgggcaggagacctcgacgacctcggcacccatcgcctcgagtttcttcacggcctcgttgaagcgcgcctcgacaccgggctggaagccttcgccgccgagctccttcaccaagccgatccgcatgcccttcaggtcgcggttcatgccctcgcgggcggctttggccatggggcgcggcccctgcggaatcgacgtggagtcacgcttgtcatgaccgccgatgatctcctgcagcaatgcggaatcgagcacggtgcgcgagaccgggccaatctggtcgagcgaggaggccatggctatggcgccgaaacgggagacgccgccataggtgggcttgacgccaacggtaccggtcaatgcgcccggctggcgaatggagccgccggtgtcggtgcccagggccaacggtgcctcgaaggcgctcacggcagccgcggagccgccgccggagccgccgggcacgcgctcgacatcccacggattggccgtatgctggtaggcggaatgctcggtggaggagccctgcgcgaactcatcgaggttcgtcttgcccagcaacggcatatgcgccgccttgagcttctcgatcaccgtggcatcgtacgggggaacccagccctcgagaatgcgcgaggccgccgtggtctcgatgcccttcgtcacgatcatgtctttgatggcgatcggcacaccggcaagctccggcagttcggccttctcggcatccgaaagattgtcgaaggcgtcggcctgctccagcgcggcctcgccggcgaccttgaggaacgccttgatcgtgggctccgcggcgtcgatcacctcgagctcggcgttcaccaagtcacggctcgacacctccttggaacgcaacagttcggccatctgaacggccgagagcttcaccagttcgattgtggcggtattcgtcatatcactcctcccccagaattcgaggtgccacgaacatgccgtcctcggcaacaggggctccggacagcgcctcggcctgcgtcaacggtgtcgcaggaacgtcggggcgcaggtaggcctcaagcggcacagggttcgccgtcggctccacatcggccgtggcgacctcctgcacggaatcgatggcgtctgcaatgacattgagctcactttgcatacgagtgatttcctcgtcggtgagcgcgattcgggccagatcgcccaaatgtactatttcttcgcgtgtgaatgtaggcatagccccaactatacgaaccaaatgtgacgaggcctcgaccgtttcactgaaaacggtcgaggccccgtatcacaggcctctccacctcgggagtgctcattcacctcacttcattcgcacatcacttcacatcgcgccgatccatcacgatcacacctgcggcgtagaccaccacggcccaggcgaggtagatcaggccagcccacccccaactcggctggaacggatgcgtcgcgcccatcgacagttgcgcgctcgcgctgttcgagaacgagttggcgcccacacctgtgaaataggtgagcgcgttcgcaggcaggcagttgttgagggagaccacccaggtgaatttctcgccgagcagctgcaccatctgcagcatcgacggcacgatcatgaacagcacgaccacgcagagcacgccgccggcggtcgaacggcacagcgcaccgaagcccatcgacatcaccgcgcccaacgccatcgccaacggtatgccaagcagcgtgacccacggcatcgcggccggcatctcggcattgccggtgctcaccgacgagcccatcatgatcgccgcgcatccccacgccagcagcatgccgacgaaggaggcaaggaaggtcacgacggcgagcaccagcgcctttgcattcatgaacatggtgcggcgcgggttcaccgtgagcgacgtgatgatcgacgaactcgagaactcgctggtgagcaccatcacgccgagaatgccgacgatcaggagcacgttgtcggcgccggaactgaccgcggcccacaggtcctcgttgccgagcggcatgccgtcgccctgcgattccacgaacctcatgagccaacccatcatcaggctgttgacggcgaagaacacaatggcgagcaccaacagcacgtaggtggacgtcacgctccacaccttgcaccattccgctcgcaatgcgccgccaaagcccagtcgcctggcatgcgacgcaccatgcgctgcgccatgtgccgcaccggggaccgttcctgacggcgttcccgttggattcgctgattgcatggcaccactcatcgcgcccctccgttccccatgttctgcaccggcatgttctgcattggcatgttctgcggaatctgcgcaccggccgccgtcatcggcgcgctcacatactgtgcatgcgcgtgcgtgagttccatgtatgcctgttcgagcgagacctgctcgcgcgtgaaccggtacgcgacgatctgcgagcgcgcgaagccatgcgcgacggcggcgaaatcggcgccttcgattctgaatgcgcgcgagtccgccgggtagccgtcttccacggtggtctccgtgatgcgcacgctcggcgagttcgcgaacatcgcctgcatgcgctcggcatcgggcgtcaccacggagagcagatcgcgcgaatgctcctccacgaaatcactcactgtggtcgtctgcaaaatgcggccttcgccaatgatgaccagattgtcggccgtgagcgccacctcgctcatcagatgcgagctcagcagcacggcgcgcccctcggccgcgcaattgcggcacaggtcgcgcacccatttgacgccttcggcgtcgagtccgttcaccggttcatcgagcacgaggttcttcgggtcgccgagcagcgatgcggcgatggcgagtctctggctcatgccgagcgagaatctgcccgccttcgtctttttcacactggccgggccggtgaggtccatcacttcgtcgacgcgcgatttcgagatgttgttcgtatatgcgagcgagcacaggtatgcgtatgcggacctgcttttcggcgcgtattttgcgtcgagcacttacttggcgccagacattttcgtaacgccttgtatttcaatcacccgggcacagtatcacgccaacgccgtcggatgcggccacctgtccacttttgccagacacccgtggctgcgaatgcccgtggcgtacgccatacgcgtacgggtgcgaacagatggcgtcccactgcgcagcgcgggacactgcaatgtgggcagactgtgcgatgtgagcagatatacggtgtcggactacgcaatgtgggcatgctgcgcgatccacgcatgcatggtcacggcggccgccgcaccggcgttgatggagcgcaccgagccgaattggctgatgtacacgacgtcgtcggccaactcgagcgccttcttcgacaggcccggtccctcggcgccgaacagcagcaggcagcgttcggggaagcggtaggtctccatgggcaccgcgccgtcgatgatgtccatggcgatcaccttggcgttctgcgcaatgttcaggtcgtgccgcgcgtacaccagttcgcgggcggcgtcagcgggactcagcacgccggcttgggccgccgtctgcgccgtctcgatgcgctggcgcgcctcggtgcgttcctgtgcgatgcgcgcgtgccaatcgtccacgcaggcgcgaatcgacgggtgatgcaccacatgctggtacagctcggtcatgagcgcgcctttgcggttccatttgtgcggacccacgatgtgcacgcggttcgccgtgaaggcattcgccgtgcgcaccattgaaccgatgttgaagtcgtgcgtccagttctccacggccacttcgaacatatggcgcccgcgggcgtccaaatcggccttgatcgcctcgaccgaccagtaccggtaccggtcgagcacgttgcggcggtcgccttcgtcgagcaacgcggcatcgaatctggggtcgtccgggcgcggctcctgcaggtgcatctcggcccatgggccgacccccacctcacggaattcaggctcgccggaggccttggccagcacatcgatcggattcggctcatgcatggcccattccctcccttttcggcttccagtgcagatcagcgcagctcagtgcagctcggattcccggaacacctcgatgaacggcagttccgccgtgctgtcgtcggccggattcaccacgcggatcaccggatccaccatatccacaccgccaatgagcgaggccacggccaccacttcggcgccctgggcctcaacgatgccgaagtcgaggctcagttcgttgccgttgcgcaatgtgacgagcgaagaggtctgcacatacgacttctccgacagccatgcgtcgagcagcagcacgcgcttgccttcgatggacggccctttgatcgaggggaacacgaagtccatcacgaaaccgttgaggtcctcgccacgcgaggcggccgcgtgcatcatcgcgcacaccatcggcacggccgcggcggtcagcgcgcccaccgcgtcgaaatcatccaccgaataaccggcttcctcgatcgtgtcgagcagaatatggccgatcagcgaggcgccatgggagtcgaacgtgacgtcggacaactcggagaacggccggtccgccatatgctcgcgcagcattcgtttgagctgttcgcgcggctccatggcggagaaatccaccgcctcctcgcggctgacggtgcggctggcggcctgctcgctgttcgaaacgccggtggggcggaatccctgtgactgactcatggttccagagtaatccgcgaacccgatttcgccgccaggtccgcaatgcgcatgctcatccccgcgacgtatgggaatgctcagcgcttccgcgtacagtatgggtatacacgaagccgaacaggaagtgccatgactctcaacacattcatcgcggcggtctgcgtggtggtggcgatcatgctcaccattgcgcacatccgcttcttctttggcgaggaaacccacaaacagcagggggagctgttccaccagccgccgcacgacgaggccgcacctgtgtccgccggcgacacgttgcgcacacggcggcgcgacaacgccgcggacctgcgcatattgcgcaagcagatcattgtgggcgcggcgctcacgctcgtcgtggtgattccgattctcattcacaccttcgccccgcattgcccgctcggacccctcgtggacccatggtggcaggcggtgctcatcacgccggtcatgttctacagcggctacccggtgcatgtggacggctggtcgtcactggcggaccgtcgcccgaacatgaacacgctcgcatccataggcacgatcgccgcctacgcctacggcctgctcatctgctttgccggcgacctgtttcccgcgggcatgcgcatgtcgtatttcgccatcgtgggcattgtgatcacgctggtgttgctggcgcgcctcgtctccgacctgtatctgccgcagcagccggcgttcccgctgcagttgtgggtggaccgtttctcgttcgtgttcgtgcccgtcgtgatcatgatcgccctgtggacgttcgtggcatggctgttgttcggcaggcagccggcgctgccgatggcgctgctcaccgcgatctcggtgctcatcatcgcctgcccgtgcgcgctcggctgggcggcgacgcttgccgccgtgttcgcgaatgagaacgcaggccgccatggtctgcagattcattcccttggctcactgcagatcgcccgtcacctgaccgacgtgctgttcgcgcaggaggcggcatcgcgctgccaggaagacattcgccgactccagcaggccggcgtctccacttcggtcatcgatgcggacgccgtggacgacgtgctcgccaccgtggattccatgcgcaaactcgccgtgtcgctcggccaacgcccggtggtggcgttcgtgggcgacggcccgaccgatgagcgcattcgccacgccgtcgacatcacgctcgaggtcggcgaggcgaaggaaggcgaagcccatggccatgcggatgtcatcgtggattcccgttcaaccatggcggtgagcgatctgcgcaatctctcccacgcgatgatggcgaatattcgcgagaatctggtgtggaccttcgcgttcaacatcattggcatcccgattgccgccggcgtgctctacccgttcacctcgtggctgctcgacccgtcgttcgccgcgatcgcgatgattctcagctcgctgtgcgtgctggtcaactcgctgcgcatgcgccactacaacccggaacgggcgtagtgactcaaggcttgcagattccctgaaacacgcagaaggcccgcgcggattgcgcgggccttccctatatcagtcgccatatggcgattcggatcaggcgtccttctgttcgccgtcatccttcttgtcgtcaaccgtgatctgggagtctccagggttcgggtcgccttccatcgggttgtgcgtatggtcggtgagctcgaggtgctcgccaccggtgtggtccaccagcacggtgtcaccgtccttgatctcgccggcgagcagcatgcgtgccagctggtcgcccacctcggtctgcaccagacggcgcagcggacgcgcaccgtatgccgggtcgtagccggtgtcggcaagccattcgcgtgccgcttcggtgacgtcgagcgtgatgcgacggtcggtgaggcgcgaagccacctgcttgacctgcaggtcgacgatcttgccgagctcctggcgtgtgagcgggtggaagatcaccatgtcgtcgagacggttgaggaactccggacggaactggctgtgcaccgcgttcatcacggcgtccttcttctgctgctcatccaggtcggggttgaccaggaactgcgagccgaggttcgacgtcatgatcaggatcgtgttcttgaagtccacggtgcggccctgaccatcggtcaggcggccgtcatcgagcacctgcagcagaatgtcgaagacctcggaattggccttctccacctcgtcgaacagcaccaccgaatacggacgacgacgcacggcctcggtgagctggccgccctcctcgtaaccgacatagcccggggctgcgccgatgagacgcgagaccgacgacttctccatgtactccgacatgtcgatgcggatcatggccttctcgtcgtcgaacaggaattcggcgagcgccttggcgagctcggtcttgcccacgccggtcgggcccatgaacaggaacgaaccggtcgggcgattcgggtcggacaggcctgcacgcgaacggcgcacggcgtcggagaccgcacgaacggcttccggctggccgatcacgcgcctgttgaggtattcctccatgttgagcagtttctcgttctcgccctgcatgagacggccgaccggaatgccggtccattcggagacgatgccggccaccgaatcggcgtccacatggtcggggaccatgggctcatcctcatgggcgaagtcggcttccttctcggcctcgtgctcggcttcggtcagctgcttctgaatggccgggatctcaccgtacagaatgcggctcgccttcgccaggtcgccttcacgcgtggccttgtcggcctcgacgcgcttctcgtcgagctgcgcacgcaggtcgccgaccttgttgtggccttccttctcggcgttccaacgggcgttgagtcctgcgagcttctcgcgggcgtcggccagttcgctctggagcttggcgaggcgctccttggaggccgggtcctcggccttcttcagctgcatctcctccatttcgaggcgcgtcaccttgcgctgcagctcgtcgatctcctcgggctgcgagtcgagttccatgcgcaggtgcgcagcggcctcgtccaccaggtcgatggccttgtcgggcagctgacgaccggtgatgtagcggttcgagagggttgcggcggccacgagcgcgtcgtcgccgatcgtcaccttgtggtgggcctcatagcgctgcttcaggccacgcagaatggcgatcgtgtcctccacactcggctcgcccacgaacacctgctggaaacgacgctccagggccggatccttctcgatgttctcacggtattcgtcgagcgtggtggcgccgatcaggcgcagttcgccacgggccagcataggcttgagcatattgcccgcgtccatcgagccttcggccgcaccggcaccgacgatcgtatggatctcgtcgatgaaggtgatgatctggccgtcggactgcttgatctcgtcaagcacgcccttgaggcgttcctcgaattcgccgcggtacttggacccggccaccatggagcccaggtcgaggctgatgaggcgcttgttctgcagtgtgctcggcacgtcgccggccacgatgcgctcggcgaggccttccacgacggcggtcttgcccacgcctggctcgccgatcagcaccgggttgttcttcgtgcggcggctcagaatctggatcacacggcggatctcctgatccctgccgatcaccgggtcgagcttgccttcacgggcacgggccgtcaggtcggtggagaacttctccaacgccttgtacgaggcctcggcgtccgggctcgtcaccttggcgccaccgcgcacgttcgggatggccgcgcgcaccttgtcggccgtgatgccgttctgctcgagaatcttggccgcctcgttcggggcggcgtcgagaatgcccagcagcaggtgctcggtggagatgtactcatctcccatgtccttcatttccttgctggcgtcggccaacgcggtggtcagctggcggctggccgaagcctgcgcggtcgacgagccggaagcgctcggcagcgagaccagggcattgcgcacctgcgcgccgatcgtctgcctgttcgcccccacggcctcgatgagaccaccgatgacaccgttctcctgacgcagcagcgagtcaagcaaatgcagcggctcaacctgcgggttgccggcggccgaggcgctctgcaccgcgtcgcccaaggcctcctgagccaaagtcgtatatttctgttccatatcatcctccatatttcgccgggcccgcgaatgcgcgaccaggcgaagtcgtcatctgatatgttcaacaacggcccggcacggttattcccaaaacttgagtgattctgactcaagttttaaaatatgccccgcagcgtcgctgccgacatatgtcactgccattgtggcgcgaaacgaaggaaggctacccgcgttatgcggatagccttcaaaaatcacagcgaacacccagcttgcggggaatcactccccctgcacgaccacgttgcgcagttcgccgatgccctcgacgcgaacaatcgcctcatcgccgggcttgagcgtgcccgaggcgttcggcgtgcccgtcatgatcacatcgcccggcagcagcgtggagaagctggagataccggcaatctgctcggcgatgttatggatgagattcgccgtggtgccgctcgccgcaggaacatcctcgccgttgagcgtgaagccgatcctggcgtcgcgccagtcgaactcgtccttcgtgacgatccaggggcccagggggcaggaggtgtcgaagcccttcgcacgcgtccacatcgggtcggagccctgcaggtcgcgcaacgtcacgtcgttcacgcaggtgaagccgagcacatagtccatcgccttgtccaccggcacgttcttggcgatgcggcccatgaccacggccacctcaggctcgtagttcatgtcgtgcgaatacgtcgggtacacaatcgggtcgtccgggccgatcaccgaggtcgacggcttcgtgaagatcaccatctcagccggcgcatgcgcctgcggcgactggttgtgctcatgcatgaactgcgcatgcgcctcgtagttcttcgcgagcccgtacaccttcgacgggatgaccggtgcgagcaaacgcacgccgtcctcgtcgagcgccacacgctcgccggtcggcgtcacctgctggagcagggggtgcccgtcgagcaccacgaggtagtccttgccgtcggtggcgtccttctgcacgaaggcgtactgcggcgtgtcattgcgggaaaatcgtgcaagtctcatacgcctcagtctacgccctggtttcaccggacgcacccatcgggtcggaaccggcgtcgccatgcggtgccgagagcttcctgagttcgcgcgacagctcgtccacctggcgttccagttcgtcgatgcggcgcacctgctgggcgatcagcacatcgcgtatatcgccacgtgagccaatggcctgcggcgcgaacgaagcatcgatatgcgtgggggcgcgcagatcggccatgacggcattgcctcgcttgccgcggggttgtttcaccgttgtcgccgccacgttcatttgcctgcgccaccgtgcgatggcgcattcgatgcgcttgtagccaatgagcgaggggtcgagcccggcttcgcggaacagttggaccggcgactccccttgcgcgtaccgcagcacgcagtcgaccttgaactcctcggtgtagatgatgcggttacgcgtggcatccgccaccgcaggcaatgttttcaggtacgcgacctcttcgacgctgaacgcgccgcccccgcttgccacctttggccccctctcccagaccttcgatctgctgctttcaatgtaccactgcgacaatcggcaccgcaatgtctggcacacgctgcatgtcgacaacatcggcaaccgataagccggagaaacatatggttgtgcccgcctccttgcgcaaggaggcgggcacaacctattacgagatatcagttcatctctcagccgcgaagctgctgcttcaggctgtgggagcgcacagcgatgagcgcggcggctccaccgatcagcagggccaccacgaccagcatcgtgatgcccgccgcaccggtgagcggcagctgcgtgatggacttgacgttcttcacctgaatgggggcggtaccagaggcctgcgtggcaagacccagcagattctcacccgtgtccaagttccaagatgccgaggtgacatcatccgtggttgtagaagtgacagtagcgttgaacacggccttgaagttggacgagtacctactcaacacatcggtttccgtgaccttgtacgtgccagtaggaagaccatagatgacgatgctgccgtcctcctgggacgtaaccttgctgacggtcccgttgccaccattgggcgcataggtgtaggtgttgtccgtgtgctgcacgaagttgagaactttgccctgagcatcagtgagctggaatttggcgcctgccgcaccgttcttgtcagtgtcttccacgccaaccttcttgagctggagctggctcacggcacgtgtgatctcctcggtgcctcgccaatcagtggggtcatctccgccgacgttgaccttattggagacggtatccagcgcatcgctgttcaccgtggccgcataggtcaccgtcacctgcttgccggccaattcaggatgagcggttgcatactctgtcaaatccacagtgaagatgttgttcttgccattgccttgaatcgggaatccctcagtgccggtgatcgtagtcccgttcaaatcagcgccggtgaagccttgaaccacgaaatcggtaccatcagtcagctgagtaccattgacaaagaccttgatgttcttctcacccgtcgctggattatcgacggtcaggccgagacccggcgtatcgatgatgtagtgatatttcacggtgctcgttgcatcatgtgccggcagtgtggaggtgatggtgtagtgaagcgtgtcaccgaccttcagcactttcggatcgttggcgtcgatggtcttatgcggcgtaggcacgaccatcttcacattcagcttacccagcgtaatggtgccgctgggcttctgggcgatcgacgtgtactcggccaccgtcgatggcatgatggccggcgccacttcagcgtcctcagcaccgctagtgcaggtcacaagataccagcccggctgcagaccagtaatcgtggcagatgtcgctccaggtgccaccgttgcctcatgggtgctgttcagtccgctacctgccagctgcttcgcaagcacacggagctgcgaagacgaaagcgtggtcacgagcagggccagattgttgtcgaccacattcgcggcagtcagatccacatccgtcgtccaacctgccggattggcgtcattcagggcgttaatggccttcttcagggccgcattcgcggctgcaggggtgctcatcgccaaatcgttgattactccatttgcgcccgtggcatccgtgaacgtcgccaactggtaggcctggaacgtctggccttccaatgcctcattgatcgtgatggattcagtagaacctgtgagtggggctgcattggcggttgccgcgccaatcgccagggtgccgagcgccgttgccgcggcggccacccctgcgaatactcgtttgagattcatgttcattccttctctgttgtgtcatgggctgtgacgccccgaacgcacgcatcctctcggacacgccgtgcaatgcccgacgcaatgcgaggggcataacacacatcttgatattctgttcagttgttcctgcgcctcacaggcgaaggaggtgcggccgggcctgcttggcccagccacgaagtcatagggcatcagagcatgtgacgcctacgccaagcggatatgcctactgcactcaggacagccaacgcacccaaaccgccagcgactgcgagccatgccaaaggcgtggcaccctgttcaccggtgaatggaagctgcgacaccgcaatccagtgattggtgaatgcggcaagatccttgttggattcggtgtcgtcagtgtcgttgacaccgtagcgataggtcactccggtcgggatcgtgtccccctccgtggggacgtggacagtgaccgtcaccgtgaccgcgtccatgtccgctgcccatcctgcgctgggggagggggcgttctccctgacattgaaggtgtacatcgcatccgcgccgagctgtggggttgccaacttgatcgatgtgtcagcaaaggttccagtcacctgcgtgccattggcgaaccggtcgccgagtgtcagcgtcgcgtccgtgaatggcgtaccgtccgcattggtcacaccttctgcggtgaccggtgacaacgtgaacgtgaagtcctgatcggtgtccgtcccttggacggtcttgccgacgcggatctgattcaggttgaagctgatcgcggccggatagttggtcacggtcgaactgtattcaccggctgtattggcgggaatcgtgatcggcttcgtgtaatgcgtgtggaatccgtccactggccgttcggtcacggtatatgtgcggtcagcagccgctttcgggatgagtactgtcgacgtccagtttgagctcttactgatgtcaatgtctgaatagccggtgcacttgccatccgtgtccatgcacgtcacgtccacagtgaccttgtcctgttcaggattggtcgcgatccacgccttgtcgatgctcaacctggcaaactgcgtagtatcgacctggatgaccgggtgcgggtattcagtgccttcgactgggccctgttgttcgccatccacgcggggcgtgtagtcgatcgtggccctctcgttgctccggaagcctgactgcctagccgacgaagcaccggtgtcatcatcgcccttggtatcgccatacccgttttttccggcattgacgttggccgcatactcctcataggccttggccgaagggacgatcttgtactccaacgaatacgtgtatccgtccttcaacacatacccttgagggaacgagatggatatcgtcttcgaccccggctgtgcgatggtatagtctgtcaatccgacctcggacgggtccaccttcttgccatccttgtcacggatgaccagctccgcgtcgaagttctgcgcatttggtttcgagaactcgacgtagtccgacagtgtatccgtcatcgtcacatcctggtacgcggtgccggacgtgacgatactgatgatctccttgaagatcgtctgcagatcggtgcgggcggacaccgcatagtagtaggttccttctactcggtcatggggttcgctcatgctctgcgctttcggatagttgctcgacacgtagttcatgaacttgttggcgttatccgtaccactcggatccgctcccggcatggcgccgatggaaataacttgggaatggtcgttcttgagctgcgccgcagctttgatcgcgttgttggcgatcttggcttcgaatccgtcgctcgacgtgggagaaccatcgctatagaagacggtcagtttctgtgcaccggggcggcccgaattcaattgcttgaccgcatgctgcaagccgaagtcggctcgcgtggcaccgcccgctttcagcgagttgacggcggcctgttccttctgcagatcctcaggcgtccaagccaaggagtgcaccgtctgggaatagttatagttatacccgtcctcattgtacgtgtcgttgccgattttatcggagttcttgcctgcatacttgatcagcgcgacctgcaccttcttgccggggtcgttgatacgctggttctgatcctcaacttggtccaggaagtacgtgaccgcatccttcaacgcatccaagcgagtctcctcgctctgcttcgatttataaaattggacgtctggtgatacactcgcactcggtcctccgatccaattatatgtgactgtatacttctgcccagccgaatcttgatcttgccatgtcgtgcaccgtccccaacttatcgcagaacaccttacagcttggtagcttccatctttctcgacataatacgtggagatgggattcatggatagcagctccacctcattatagacgagcttgcctgagagttcattcatactgccagatacatccagcacgagggcgatgtcgagcgggacgacctgctgctcagtggattcgtcggacttgcccgtcacatccatgctcagcgtgtatgtcccgtcatcgttcttggagattcgcttggtgtgctgtggagcgtccacgttcccagcactcgcggttgcggcttgggggtccgccgtcgcggccggctgcctatcgtcggcaaaggcggccacgctcgcgctggccatgccgaggctcatcgccactgcacacaacgatgcgagaacactgcgcaacggtctcgcgcccttccttcccgcatgatcactcgcgccagattgcgcggagcggtgcttcaatctcttcatacttcccccactgaaatcagtctgatcgaacaaatcaatcttgaatcgagcatacacggcttttttcgcggtagacacactctattcaaggggttcaattcgccgttagattaaaggtttatgcccatatcttaccaaattgataccctcaagatataccctcgtcaacaatttcaaaccgtagacgccgcatatatttcaaccatatttcacaaatccaagtagatccccagcggctgcacgccgtcaaccaccaaatagtccactccggagtccattattcggacatgacatcgtcgggacgcgcatggcgcatccgttccacgcgtgtgcgggcgcgcgagaaccatgtggccgcaatcaatccgatcgccaacgccacaatcgccgccatgattcccaccaagcgcccgtcatgcacatccgacgggttcggagcggggtacggaatcgaaacgcgatgccctgagacgagcaaccgctgcgtgttcacgccatacggcgtacacgtcatcaatgtcacgcggtcctcccccggcaccaccctcagccgggacgtgtcgtctgggttgatcacggtgatggaatccacggcgtacgcgagtttttcgcccatcacatctatgtagaagtagtcgccgtttttgatctcatcgagtctcgtgaacatgggggcatccaccaggccacggtggccggtgatcaccgcatgcgtgttcaggccgcccgcaggcaggctcgtgccatacaaatgccccgcccccgcggcgagcgcctcctccgacgtaccgtggtatatgggcaggttcacgctgatcttcggaatgctcaccgaccccatgatgccgccgccggtgtcgagcagcgactggtattcggagtccttgctcgccgcggaatcacccttctccgacacgctcgacccaccggcccgctgcgagaacgggtcgacggcctcacccagaatcggctgtccgctcgccgcaaggcgctggttgtacgcccgcgcatccctcagcttgttctccgcctgcgggtagggccatccgagcacacgctggttcaccattcgcgtttgggcggagagctgctgcgacgacctccattggagcacgaagggcgtggcgcccaccaccacggcgacgatggcaagcactatggcgaacacgcgcaatgcgatcatgcgccggcgcaacgacctgcgcaactgcaccacatcggcgacgtcggtcgcctgttcgaacgtgagcggctgccattgccgggcagcggtcccctcgccgccattcctacgcttcctacgcatcgtcacccccatatccaatccggcagcaacgccgaatcggcctcacttgaagtcgcgttcgccgaagatggcggaccccacgcgcacgatcgtcgccccctcggcgatcgcatactcgagatcgccgctcatgcccatcgacagttccacacaacgcgcggtgccgggcatgccgagtgactggatgcgctcgcgcaggccgcgcaggtgtgcgaatccctcgcgaatgcgacgctcgtcgcgcacatgcgcgcccaccgtcatcaatccctgcagttcaacgccccccaaggcggcaatctgctcggcaagctccaatgcctggtcgggcgcgcacccggatttcgactcctcaccggattcgttcacctcgagtagcacgcccatgctgcggccgcgcaccatgcaacgacgcgcgatcttctccgccaattcaagcgagtccaccgactcgaccgtgttgacggtgggcaggatcttgctgatcttgttgctctgcagctggccgatcaaatggaatggtatgaacggggcctccttgagatcctccggctcggcataggtcgggtcggcatcgaccgtcaggtcgaagtcatacgcgccgatcacatacccacgctgcttgcactggtagcgcaggccgtcgatcttcgccacgacctcctgcggccggttctcgccgatcatcggcacaccggcgtcaatggcggccatgatctcgcccacgtcgcgcgtcttcgtggcggcgagcaacctgacatcgccggccggacgccctgcacgctcctcggcagcggcaatgcggtccatcacacgatgcacgccatcggcgatctgctgtgcacggacctcgtcaatgacctcgttcgccagatccttgtgatccatatatgcagtcattccacccccaccttccgtgtccaaagctttcctcacaggtcacaatagcgcaatttgcctatgctcgcatgccccgcgcggcacccgtgcaaaatccgaacatcacagcgcgcgcaacacctccacaatgttccccggcaccacgacgtcgcccgcatgccgccgcactttccgccatgagaacagattcagcgcctgctgcgccgacattgcctccgggcgttccagcaccccctcgcataggcccatatgccatgcgcagtacccgatcacctgatccgggcgcacaccggcctcgcgcaggcgccccaggtcgagcgagcgttcgcgtttggcaaggcgcacgccggcggcgttgtcgagcaacggcacatgcgcatactgcgggtcggcggccggcagattgtgcgagcccaaaccggtgcgaagcatctgcccacgcagccagatctgcaatgcggtggaacgcagcaggtcacggccgcgcaccacgtcgctcacgcccatgagcaagtcgtccaccgtcaccacgaactggtacgcatacaggccgtcggaacggcgcagaatcacatcgcccagctcgcggcccacattgaacgactgcgcgccatacacaaggtcgtcgaatgcgacgaaggcgccgggctcctgcgcaccgggcaccgccaggcgccatgaatgacgccgaccggcagcgagccggcgttccacctcgtcccgatcctcatcacgcagacgtcggcaggtgcccgggtacaccaggaatccgtcgccctcctgcggggcgcttgcggcgcggatctccgcacgcgagcagaagcacgggtagagcagcgcgtcaccgtcaagcgagcgcaggcgttcgaacacggcatcgtataccgcttgccgcgcggattgatacacaggttcgccgtcccagtccaagccgagccaagtgagatcgtccatgatcatgcggtcggcgccggggagcacacgtggggtgtcgatgtcctcgatgcgcaaatagatcggctcatggcgcgaccgtgcggaaagccacgcggcgagcatggcgaacgcgttgcccaaatgcatgcgccccgacggggtgggagcaaaacggccggccatcagtacgccgtccacaactcgttgtcgagcggccatgcgttcggagtgcagccgcgcaagtccatcgactgctcctgcatgagcggcgccctcttgccctcgccctcgcacacggtctcgttgtcgacgtggccgagcacatggcccacctcatggttgagcaccatcgtgcggtactgcgagagcgtctcgccatgtgcaaaccagtgttcgacggcctcgtcccaacgcttcttgttgatgatcacgtcggttcccacacggcagctgtattctgcagagcaaccctgcgaatattcggccagcttgcttgattcggcgagcatgatcgtgaactcgcaggcattcgtgtcgtgggtcggcgcgaatatgacgcccgcgcgcggccagccctgcggattgttcagcacgcggaacaccgtgttggcgaatccttcggccgagcccacattgccgttcgtggccacgcagtaatgcaggacgaccggcgtcttgttatcttcgtatgccgcctgcctcgccttgtcgagaatctcatggcgttgttcgtcactcagcggcgcctcgagtgcggcgatcgcctgcgcgtcctgctcggcatgcgtgttctcgctgtgctccgccgattcgctccgctcggtgttcgcccgctcgatctgggcgtcgtgaaaatgcgtgggcttccaccgcgatgccgccccggcgttcgaggaggcctgcagattgcgcgcttggaacagggcccgcgcctcgcctgccacgctcagccagacgaacacgatccagagcacggtgacgagcagaaccaccacgcggcgcatgatatacacacgcttcggcaggcgccgtttccttcgcggcgacgactgccgcgaagagcgtatggagttctgtttgtgcgagccggtcatacgctccagtatacggtcacaccaccgcattccgtccggctgtgaaccgagggcagacgcccgcatgcgcgcattccgcgcggatacaccgaatacaaaaaaccgcacccgaaggtgcggtttgcatgcatgccggcaaccgaatgccgggcatatcagatggcgaagagcacgtgaaagagccagcagccgatgatgccgccgatgatcggcgcgacgaccgggatccacgcctcgttccaacgggaggaacccttgtgcgggatcggcaggatcgaatgcagcacgcgcggcatcaggtcgcgggccgggttgaggccggggccggtcgggccgcccatggagcacacgaggccccagacgatgaagccgacgacgatcgaggccgacgcgtagttctggcggccccactgcaactcgaggcagcacagcgcgccgagcacgaggatcatcgtgccgaagaactcgttgatgaagtagttgcggcgcgtggcctgcgcgtcggtcgtgcagaaggtcgagaggatcgcctcggcgttctcggtctccttgtagtgcgggtagtagcacacgtacacgatgagctggcccaccgcggcgccgagaatctgcgcgatgatgtacggcagcacgttcgaccacgggaacatgccattgaccgcctgcgcgatcgtcatcgccgggttgatgtgcgcgccggagacgccaccgaacatgagcaccgggaacatgacgccgaagccgtagcccatggcgatgttcagccagcccgcattgtggcccttcgtattcttgagctcgacgttcgctactgcgccgttgccgaagatcatgagcacagcggtgcccacgaactcggcggccaacttggtaaacagtgagtattccaccgggaaatccttgtcttcttctcttgattcccacggcgtctggcaaacacgttgtgtcgtgggcgaattcagtgtacgtccagcactggtcgaacggcatgaaaaaacgcgcgcatgtccagcgtatggaatgcgcgcgttatgcggaacgctattcagtgctcctcgttcgaacgcgggtcgcggatccaacccagtgagacgaggatcagcacgcccgccagcagcagatcggacaggctcgtcgccgcatcctgcggcatggagcccagctcgaacagcccgacacgggccgcgatgagcacccaggcgagcacatacaccacaatggacagcgccctgaagcctgtcgtgcagaaccgcagcacatagacatacgccgccacccacaatgccagggcgccccacagcacccacagccacaccttgtccatctccggcaggccgatcatcacgccaccgagcgcgatcacacccaacgcaaagatgatccattcaaccgcataccgtttcatgccactccttaccgtaatgttccaccgttgtaactcatgcccatactagcggccccactgccgcacaccccgcattgtctccccgcatatggccactggattcgccggtcgtggcatgccatcgtatcgcgcagaccatcgcgggtgacttccttgtgcgcccgcatttgccgcaaaaacaaaaactcgcgaattcgcgagcttcattcagattctcctagcacccgaggtgcgtcattcacctcagtagtccagattcccatgatcgttggaatcctgctgcgcaccctgcgcagtttccatcatcagcttgtcaagggcagtcgtcgtggactcccatctgttgaacatggcgatcctcctttcctcagctccgactcatgcgagatgccggtaattcgtcagaacctcacattttgtctgttcgttttgcccttcacaatatgcccacatatacgaatattttctgcccacagcaagcacaatatggacactgcgaatggcacccgccaacgatcccggcccatcgggaaacacaccgaaccggcaaatacgaaaggccccagccgaagctggggtcttccattgaggtgccccctcagggactcgaaccctggacactctgattaagagtcagatgctctaaccaactgagctaaaggggcttggttgcttgaaccaagagataaatatactcagattcacggaagatgcaaatcccggcgtgtcgcattctgccgccaactgcccagtgcttcccgcttgcggccattcggcgagatagggtcgccggctattgcgccaggtgcaccggaagacagtcctcactgccgtatccgttggcagtgcaccagcctttcgcggcctgtgccgtggcaaacgtctcgccgctcagcatgacgtagtaatccgaggggtgccccgagcgggagtagttcgtgtaatcgggaccccatacgagcaatgcattcgggtactttgccttgagctcacggtattgtccgaggatcgtctcatacgtccacgttctgcccgccgcctgcaggcccggcttcttgcttgacaactgggttgtgtacacgttgagcagaccggccgccttcgctttgtcggcctccacctgccgctgcagctcgtcgtacgcctgttgttcggctgcagattcccgcgggtgttcctcgtctgctgcaccgccggtttcgccgccgtccatggattcactcggcgtcggctgcacttcgctcgtcggttgctgcgcagacgcatccggatgcggcctcggctgcgtcctccacgcccacacaccgattccggccagtatggccacaatcagtacgatggcgacgatgatccacacatgcctgccgttccgtgttgctgtggatgcgtgcgctcgtccggtgcgaggcaccgccgaatcgttgaccggctcgcctgctgccgcagttgccgtcctggccggcaccctccttctcgcagactctgcaggaggcaacgaaggtggcaacgccggactgttcatgttcgtcaccagcggacgctgttgcgattcctgcatgcggatcggctgcatcaccgcggtcgtcgtcgcctcgaacgccaccggttgaatcctgtgttccgtatgggtggactgcgattcctgcacgggctttccacacaccgggcataccgcatcatccgcattgggcgggctaccgcaatgtgggcactgcacggggccttctttctcttataccatcgccggagcgcacggaggaactcgcggcggatacgacttcattgtacaggggagggcgcaggcatgggccatatacaaaggcccctgtgaccgtgtacagtcacaggggccttcaatgcttaagctcagactggttgagaccgaccggagccggtcatgagtctatgggccggattactcagcgacaaccttcacgaagaagttggcggagatctccgggtgcagggccacggttgccgggaactcaccgagggtctgaatcttctcgacggtgatgcccttcggatcgacggcgaccttctcggcaagcgcgttggcgatctgctcgttggagatgccgccgaacagcttgcctgactcggaaaccttggcaaagatctcgacggcggtgccttcgatgatctgctttgcctcaacggcaccctcacgggtggcgatggccttggccaagcgtgcgcgcttcatggcctcggcctgagcggcggcacccttggtccacgggaaggcatagccctgaggaatgaggtagttgcgtgcgtaaccagccttgacctcgacgatgtcgccggcgtggcccaggttgttcacggacttcttgagaatgatcttggtagtggccatatctatactctcctcacaactcagcggccgttggtggcgtatggcagcagagccatctcgcgagcgttcttgatcgcggtcgcgatcttgcgctgctcctgaacggtgacgccggtaatacgacgggaacgaatcttgccgcgatcggaaatgaacttgcgcagcagcgcaacgtccttgtagtcaatctcggtgatcttggcggccttgagcggattcggcttcttcttgaacggcttgaccggtggctgcggcctcttgcgtgacattcttgttgtctccttacacgtggaaaatcgaaatacttgggtaggcgtcagaactcgggctcgtcggagtcaccaccgaaatcggaggtgccgaacgaaccgaaggcgttggaggagccggaatcgttcgaccatgggtcggagaccggcgctgacggggcctgcggtgcaggagcggacgcaccgccctgatacccaccattgccgccgttgaagccgccaccggagtagcctgcgccaccctggtaaccgccgccgttgttgccgtagccgccaccctgctggccgccattgaagccggagctcgtctggcgggtcacctgggcggtcgcacgggacagcgcggggccaatctcgtcgacacgcagttccacaacgctgcgctgggaaccatcctgtgcctggtacgaacgctgggtaaggcgcccctgggcaatcactcgcatgcccttcgacagcgagttcgcaatgttcgtggccatcgacgtacgtgccgagtcccaagccgagcagttgaggaacaatgtgtcgccatcatcccactggttggtgttgcggttgaacgtacgcgtggacgaagcaatggtgaaattgaccaccgtcgagccattgccgacggtgcgcagttccgggtcgcgggtcaggttgcccacgacggtgatgatcgtttcacctgccatagcgttccttcttacctatacggatttcgaaaacttgttacttgcgaagaatcttcgtacggacgatggattcgttcaggttgagaacacggtcgagctcgtcgttggtagccggctcgcaggagtacgtcacgacgacgtagttgccctcggtcttgccatcaatctcgtaagcgagcttgcgacggccccagatgtcgatgttctcgacggaaccgccttccttggtgacgatttccatgtgctgattggtcagcttcttgagaccgttctcatccagttcaggatcggcaatgaacatcagttcgtaattgtgcgcagacatcacccacctccttcggacttatcggccgcgggacttccgcgacaggagtgtgtttgcgtaagccggccgcgacattcgcagacggcaacttctcaaatatacctatgcgttcggacacgcgcacacatacatgcacattgttatattggggggtgctccatttttgtgttcgcaagcaatgtgaaaggcgaatgatgtctgctgttcttgaaggcacccccgataaacgcttggctttggtgacgggtcgtgcttacccggagcaagccaccgagaccgcccactacctcggcaccgaggtgcttccgacgacggcctacgacttcgcgaacggcgagatgtacgtgcgctacacggagccgatccgcggcgcggacgtgttcatcatgcaggcgcatacccaaccgatcaacaagtggatcatggaacagctcatcatgatcgatgccgccaaacgcgcgtcggcacgctcgatcaccgtcgtcgccccgttcttcggctattcgcggcaagacaagaagcatctcggccgcgaacccatcaccgccaagctcatgttcacgctcatgcgggcagccggcgccgaccgcgtgatgaccgtcgacctgcacgcggcccaggagcagggcttcttcaacggtccggtcgaccacctgaccgccatgccgattctgctcgactacatgcgcgaccgcctgccgctcgacaatacgacgatcgtctcgccggacgcggggcgcatcaaggtctccgagcaatgggccgcgaaactcggcggcctgccgctcgccttcattcacaagacccgcgacaccacgcgaccgaaccatgccgaggcgcatggcatcatcggtgaggtgaaggaccgcgactgcgtggtgatcgacgatatgatcgacacggccggcacgatctgcgaggcggtgcgcacgctgcacgaccacggcgcgaaatcggtgacgctcgtcgccacgcacggcctgctctcgggcccagccgtggagcgactcaaggacagcggcgtcaaggagatcgtgctcaccgacacggtgccgatccccgaggagaagcgcctgcccaacatgacggtgctgtctgcggccccattgctcgccgctggaatccgctccgtgttcgaatcccgttcggtgagcaatctgctcaacggacttcccgaggacatgcacacgcgtcacatctacgcttgaacggtatgcgcccttcatgttgagtggcggtgatgggtcgggtgacgcttcgtcactggatcgcaagcgccctttacgttcctcagcctcacccgacctatcgccgccactcaacacggtatgcctctattcgcccgtctagccccccctcgtacctcgcaatagacacctcacttggaggagggacgaggagtctgtttggtggcgtatggggcagccgagccgatgagatgaggaacgtaagggcgcttgcgatccagtgacgaatctcatcggctcggctgccccatacgccaccaaacagacacagcgcatttcagttagcggaagcgctcccgaatctgcgcggcggtgccataggaggcctgcgcaccatagccggtggccgcatatgccgacacatacgaagccagttgcgcggactcctccaagctcagtccactggccaatgaagccagcacagtgcccatgaacgaatcgccgcagcccgtggtatccaccgcatccacacgcaccggggcaatgcggatgatcgatggatccaccgtggagtcaagcaccaccgaaccgtcgccgccaagcgtcacaatcgcctgatcaaaaccgaactcgctcaaacggttctgagcctgtgcccaatcgaacgaatcccagtcatcatcttcaggctcgtcaatgtgcagcagctgcacgagctcatgctcattgaccagcagaatgtcggcatgcgcaatgagttcggacggcaacgtcgcaatgaagggcgaatcgttgagcagcaccttcatacccgcatcatggcacatggtcgcgcatgcggtcactgtttcaagcgggctttccaaacacagtcccagcaccgacgatgcggtaagcagatcgcgctgggattcgatgtattccaccgtcacgttcgcgttggaacccggcgaatacacaatggtgttctcgccatgggaatccacagtgatcaccgtcgtgccgctggggccgagcaccttgcgaatgccatcggtgttcactccggcggatgcgagctgagtcagcaggaaatccgcattcgagtcggagcccactgcaccgaacatgcgcacggtggcgccgagcttggcggcagcggcggcctgattgcccgatttgccaccgggcagcacctgtagcgggccgccggtcacggtctcccccggcccggggagccgctcggtggtcaccgtgtaatctgcgttcatcgaaccgaccacggagacggatccgtgaatctgctccagcttatcgagaatctgattcatcgtatttccttcgcatatatgtttggtcgtttgcttacgcggcatcgaggtgaacgaccatactactcaccattcaatgacacagcgcgcacaggtgccgtgtcacttggctgggtggagcacctcttcgacatcctccggctgctccacttccttctgcacctgcgcggactcaccgcggtagatgtgcttgtggaacaccaggaaccagacgaggccgagcaccaccacgccggcggcgatgatcagcagattcgagtagaccgcagccggtccggtggcaccggtgagggagccgccggcgagcgccgtgccgccgagctgtgcgccgaagacggcgatgccgatggaagcggtcacgttcatcaccagatcgttcatgccgacgccgcggccggattcatcgacaggcagcgtatcgagcaccgtggagacaaccggcgaatacataagtccgcagcctgcgtagaagatgcacgcgaacagcgtgagcagtccgaagtccgtgttcacgcacagcgccgaaccgacgaatccgcagatcatgagcagcgaggcgagcacgatcgccgtggtgcgcccgatcttgccgacgatccagcccgaggtggtgccgaagacggcggccacgatgaacgcccacacaatgtactgcgagacctgcgtgacatccatgttgtagagggtcgtgcccatcgtgttgaagataggcgagacgcagtagttcgtgaaatagaacagcacgatgagcatgatcgcggcgagccaacgcgtgttcttgaagaacgcgggcgtgatgaacgggtcgctcgccttgttaatgtacacgccgaacagcacgaacagcacgacgcacaccgcgagcatccaccagctgttgtacgagaagaacagcgagaggaatgccgaggcgaggccgaagatcgtgaagccgagccagtcgacatgctgggaaccgccgcggcggttcggcagcagatgcagcaggaacggcaggaacacgatcgtcaccgccggaatgaggaacaggtactgccaggcgatcgacgtgagcaggccggccgcgaacacgccgatggccgcggagacctggtagcctgcggtgaacagaccgaagaagatcaccttgagttccttcttgaggtacttcgtggcgatgacgagatagacggacccagacacctgctcgcctgcggtctgcaggatgcgcgcgatgatgacggtccacagattcttcgtgaagaagaagttcgcgatgaacccgaacagcgagcccacgaacaacgtgaccaagccgaatacaatgagtttcttcagcgagacgaaatcgccgagggaaccgtagatgaagcagacgatgccaagcacgatgctcggcaggctcgtgatcagcgcggcctgctcgggagcgccgacgtcggagccgatgttcgtgaacacaagattgaagccctgcaggcacaaggtgccgagaatgaacgtgatgagcagcagaatcaaggcgcgcacggccatcttgttctgctgttcgaggtcaacgggctcttcctgcacaaccgcagtgttgttgggggcagtcatgatgtctcttttccacagatgcttgaaaattccgattcgtggtctgcatgcagaccgggtgcagattgtcttctgcttgcagctatgcgttcttcgcgacgttggtgatgcgcgtcatgaactcgtcgaggaagcgcggcacatcgacgtcgagcgcggctcccatcgtcttgtgcgggtcgttgagacggtcctcatcgccaatggtgcggccgcgagtcgggccttccacatcgaccttcatgttgatcggatgcacggtgacgagcgtcgggtcgacggccacgccgaccgcaagcggatcgtgcaggccacagccgcccaagtggggcgcggtggtctcgtatgccttgatgtagaagtcggtcatgtcggcgaggaacgtgccggcggcattgccgaggtcgcgccaacgttgcgtctccttgtaggtgagcagcgtctgcagcgtcacgtccaggccgatcatcgtcgcatccttcgtatggcggaacacatagtccgccgcatcgggatcctgcgagatgttcgcctcggtccaggcattcacattgcccggcaccgtgagcgcgccgcccatcagcacgatcttgccgagctgctcggcgatctccggagccttgcggaatgcggcggcgatgttcgtctgcgggccggtgggaacgtacaccagatcgtcaccgtaggtcttcaccgcatcgatgatgaaatcgacggccggctcggtttcggcatcacgctgcgggtctgggatcaccgcgtctccgatgccgttctcaccgtgaatgaatgccgaaatgggcagcacctcgaaggaatccttcgtactggcatgaggcagacccttgtatacgggcacttcggggtgaccgagcagttcggtgatggccagcgcattgcgcacgccctgctccatgagcacattgccgtacgtgccggtgatgccgatcagttcgacttccgggctgccgagcgcatacgaaatcgcaagcgcatcgtcgacaccggtgtcgagatcaagaatgagcttcttcatgggaaccttccttcaatcctctttgattgcgacgcatacgcgccagttggtgataaaacgttttaccaagaactaccgtttattataccgcaaaacagaagaagatgcgacgctatgcaggcggcaaagattcacgaaaactaatgcctcacgttgagagccggtgtatggggagtctggaatcagcggaaaatcggcgcctgcgcgacggtgtcgccctcgaccaactgtggttcgagcagcagcaaatcgttcgcctctgcgcagttccggccggaatcatggtgctgaatatgccggtacaggcattgccaactctgcgaagcgagttcggagacattctgttccaccgtggtcaggcgcgtgagcaaaccgaaacgtttgacaatgttgtcgtaaccgattatcgaaatatccgcgggaatggcaatgccgagttcgcggaagcggtcgattgcccccaatgccatcaaatcgttgcagcagaacaggcatgtggcgccaaaatctgccacggcatcggcagcgtcataaccacccgagaatcgataattgccgtcgagagtgagaatggagtccgccggcacctcatgttcctgcaaggtcttcaaaaagccgtagcagcgcgtattcgcgttcacgctgtctttgttgccggtgatgcaggcgaatcgcctgtgacccgcgcagagaagttttttggcggcaagacggccaccgagctcgttgtcgaatcccacaccgtcacagatgtcggcggtgatcagcctgtcaatgatgacaatcgggcagggggaggcgcagatctggtcgcggagcaatgcgcggtccgtatagctgtctatggatggaataagcaagagcccgtctatgtcacgtccgacgaaattgcgcatgagtcggcgttccagcgtgcgatcgtcgtcggaattcgagatgaacaactgatacccgttccgccggcattccgtttccaagcatttggatagcgaggcaaagaacatattctcaatatcgggcacgatgagcgcgatgaggcgtgtttcattggtgaccagaccgcgcgcattctcattgaccacgtagtgcaggcgtctcgccacatcgcgaatgcgctgctgcgtgggttgggatatacgcgagggcttgttgttgagcacaagagacgccgtggctacggaaacctgggcttcctgtgccacttcccttaacgtcactcgccgcaccattttcgcctcatctattgccgtactgtgtgtagttatattctatggcacgctgcacaaagcgagggattgttcagcattgcattccaagatgacaatgttaggagatgacaatgtgaagaggcaattgggaagattgtattggattgcggttgttcctctggtttggaggcatgtaggtggggagaaaatagtagggagttgttgttcttccggtttggaggggtgttcatgggatgaagatcgcgcggtgtgatatgctcccccggttcggcggtgtccgtgtcgggggttctgcgttgtgcccgggatacggggaaggcccggggaacgtgtgttccccgggccttcggtgaagtgtggttgcggcggtgtgctactctcccatgtcctctcgggcatagtaccatcgccgtgccagggcttagcttccgggttcggaatgggaccgggcgtctcccctgggccatggccgccgcaaaatctgttatcctgtctgcgggtggcggttcgggaaccggatcgtggacgcgagtgagggacttggtgttcgtgccgccgtgatgccgccggggttttccggcttcgtcatggtggtgttggttgtcttcgaccgttagtgccggtcggctccacccctcgcggggcttccacgtccggtctatcaaccacatgttctctatggggtctcacacacccccggggggggtgtcaggaatccttatcttggagcgggcttcccgcttagatgctttcagcggttatccctcccgaacgtggccaaccagccgtgccgctggcgcgacaactggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacgccggcaccggatcactatctccgactttcgtccctgctcgatccgtcgatctcgcagtcaagcccgcttgtgcgattacactcgacacccgattgccaaccgggccgagcggacctttgagcgcctccgttactctttgggaggcaaccgccccagttaaactacccgccaggcactctccccgacaaggctgacttgtccgggttaggcatcagatggggacagagcggtatttcactggccggctccaccacggctggcgccgcggcttcgaagcctcccgcctatgctacacaatccgcacctgatgccaataccaaggtatagtaaaggtcccggggtcttttcgtccttctgcgcttaacgagcatctttactcgtactgcaatttcgccgagctcctggtcgagacagcggggaagtcgttacgccattcgtgcaggtcggaacttacccgacaaggaatttcgctaccttaggatggttatagttaccaccgccgtttaccggggcttgaattcaccacttcgcatcccgcgaggggacgctgatggatcctcttaaccttccggcaccgggcaggcgtcagtgcatatacggcgacttgcgtcttggcatgcacctgtgtttttggtaaacagtcgctaccccctggcctgtgccacccccagccgcccacgacccgcaaggggccggcacggccgggggtctcccttatgccgaaggcacgggagcaatttgccgagttccttgaccaggattcgctcgatcgcttcggtatactctaccagaccacctgtgtcggtttggggtacgggcggcaacggacctcgcgccgaagcttttctcggccgacgggatcaccggatatcacgccatgaaagcgcccatcatcacgcctcaccccatgaagcccccggatttgcctgggggcggggccacacgcttgaccagggaaaaccacctccccggccggctacccgtccgcgtcactcctgaaacgctcaacccatgcgcgtccaggccaaacagcaacggaatcaggaggccgaagcccccatcaaccgtatcggatggcccttgttcacacgggctgttggtcggtccgaaagccggtacgggaatatcgacccgttcatccattcgactacgcctgtcggcctcgccttaggacccgactcacccagggacgacgaacgtggccctggaacccttggtcttccagcggcagggatcctcaccctgctctcgctactcatgtctgcattctcactcccacacagtccacggccgggttcccccgccgcttcgccccggtgtgggacgctctcctaccacacggccatacggccgcatccgcgtcttcggtggcgtgcttgagccccgctacattgtcggcgcggaaccactagaccagtgagctgttacgcactctttcaaggatggctgcttctgagccaacctcctggctgtctatgcgactccacatcctttcccacttagcacgcgcttggggaccttagacgacggtcagggctgtctccccctcgacgacggagcttatcccccgccgactcactgccggaatagacgcgatgggtattcggagtttggttgctgttggtacccggcacgggcccgcaagcatccagtagctctaccccccacacgcaatcaaccgacgctgcacctaaatgcatttcgaagagaaccagctatcacggaatttgattggcctttcacccctaaccccagttcatcccctcagttttcaacctaagtgggtgcggtcctccacgcggtcttacccgcgcttcaacctgaccagggctagatcatcccgcttcgggtccaggacacgcgactgaaaagacgccttttaagactcgctttcgctacgcatacaccacacggcttatgctcgccacatgccactgactcgcagactcatttttcgataggcacgccgtcaccccaccaagggggctccgacggttcgcgggcgcacggtttcaggaactctttcactcccctcccggggtgcttttcacctttccctcacggtactcgtacgctatcggtcagacaggtatactcaggcttacccgacggtccgggcggattcacacgggattccacgagtcccgcgctactcgggagacaccatccatggtgcacgcgcatacggctacggggccatcaccctctacggcccggtatccaacccggttcgcctcacgcatgcatttatcaccacagccaacggcgtcggccgttggacaggcgttcccacgacaccatgcgcgcaacccccgacgggtatcacacgcgcacggtttagccatcatccgctttcgctcgccactactcacggagtatcctctcctgcaggtactgagatgtttcacttccctgcgtaccccccgcacaagtgcggtgccagcccatgacggctggcgggttgccccattcggacaccctgggatcaaagccatgtcggcggctcccccaggactatcgcggccccacacgtccttcatcggtactgtctgccaaggcatccaccatacgcccatcacgacaaccacaacacggccgccatgaccaaagcactactgaaaaaccctagaacgacatcagatcacggggacgcaccacacacggcacgcccccatacgattacgaacgaacccaagaaaaaacaattcctcggatccgaatcacagtacgaacaccaaccccaccccaacgggcgggccgatgctcgcgtccactatccagttctcaaaccaccaccccaccaggacacccaccccgcaccaacaggcaccgggcaaccgacctgggggacacactggcaaccacaccccacaccaggggccggtggcggccagggaacccaacagcacgcaccacaccacacaatccaatacgactcttccacgccagcaagccagggcggcgacgacaaaccatcgcactcggcaaaccccagccacaaaaccgtgcacaaaaccatgcacgcccatattctccgtagaaaggaggtgatccagccgcaccttccggtacggctaccttgttacgacttagtcccaatcacgagtctcaccttagacggctccccccacaagggtcgggccaccggcttcgggtgctacccactttcatgacttgacgggcggtgtgtacaaggcccgggaacgcattcaccgcggcgttgctgatccgcgattactagcgactccgccttcacgcagtcgagttgcagactgcgatccgaactgagaccggttttcagcgatccgccccacgtcaccgtgtcgcaccgcgttgtaccggccattgtagcatgcgtgaagccctggacgtaaggggcatgatgatctgacgtcatccccaccttcctccgagttgaccccggcggtcccacatgagttcccggcatcacccgctggcaacatgcggcgagggttgcgctcgttgcgggacttaacccaacatctcacgacacgagctgacgacgaccatgcaccacctgtgaaccggccccgaagggaaaccgtgtctccacggcgatccggcacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacgggacccgtggaaagggccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactccagcccgcccgtacccggcgcagatccaccgttaggcgatggactttcacaccggacgcgacgaaccgcctacgagccctttacgcccaataaatccggataacgctcgcaccctacgtattaccgcggctgctggcacgtagttagccggtgcttattcgaacaatccactcaacacggccgaaaccgtgccttgcccttgaacaaaagcggtttacaacccgaaggcctccatcccgcacgcggcgtcgctgcatcaggcttgcgcccattgtgcaatattccccactgctgcctcccgtaggagtctgggccgtatctcagtcccaatgtggccggtcaccctctcaggccggctacccgtcaacgccttggtgggccatcaccccgccaacaagctgataggacgcgaccccatcccatgccgcaaaagcatttcccaccccaccatgcgatggagcggagcatccggtattaccacccgtttccaggagctattccggtgcacagggcaggttggtcacgcattactcacccgttcgccactctcaccccgacagcaagctgccagggatcccgttcgacttgcatgtgttaagcacgccgccagcgttcatcctgagccagaatcgaaccctccacaaaaaacattgcagaaagccaaaaacgactctcaaatccatttcaaaagaaatcagacggaccccctaataaggaaagggagccacacaaaaaacctccgccatccatcaaaacccgacaggattacccacacgaaaccatgcaggcggacaacggaactggcatcataaaagacgaccaagaaccacaacggccacgacagccgaagcgacatcaaccttggtcaagtagtacagtacacgctattgagttctcaaaccaccaccacacacccacaaccccgacccgggaaccccggcaggccgtgagcggcagcaaaagaaaaacctacaccacaacccccacccacgcaaccccaaccccaaccacacacccccaaaccccaacaaacacaacaccaccaccggcgtgtcgaaaaccagccaaaacaccaaccaacacccacacacaaaaacaccaaccacaccacacagacgaaacccaccacgagcgcaacaacgcagaacgggaaccccgaataggggttcccgtccgcattcagaaagcgagttcacagaacgcaatctgcaaatacaaacaaatacaaactacttcttgagcagtggctcaacctgcttctcgtaggaaatcagcgcctggttgaacacctggtccatgtcgtagtacgcgtaggtgcccaagcggcctccgaacaccacattcggctcgtcggcggccttcgccttgtactgtgcatacagggccttgtcttcatcggtgttgatcgggtaatacggctcgtcgtcgcggttcgcgaagcgcgagtattcctcccacaccacggtcttgttcgggttctgctcggcggcacgctccgggttgaagttcttgaattcaatggcgcgcgtgtatggcacgtcggcgtcggagaagttcatgaccgcgcagccgaagtggtcaccctcgtcataacgcacctccttgaagtcgacggtgcgccacttgagctcgcccagatcgtagtcgaaatagcggtcgaccgggcccgtgtagaccaccggcacgcccgcttccaacaacgcgcgcttgttgagcggctgcgtctcgtcgaagaaatccgtctccagcttcacagtgatgcgcgggtcgtcgatcatgcgctcaagccacgcggtgtagccgtctgccggcagaccttcccacgtgtctttgaaataccggttgttgtagttgaaacgcaccggcagacgcttgatgatgctcgccggcagctcgctcggatcggtctgccactgcttggcggtgtagttcttgatgaacgcctcatacagcggacgcccgatgagcgaaatgccctggtcgttgagattcgccggatccgtgcctgccagctcgccagcctgctcgtcgatgagcgccttggcctgcgcgggcgtgtagttcgcgcggaagaactggttgatcgtgcccagattgatcggcagcgggaacacctcgccgtcgtgcgtggcgtagacgcggtgcacgtaatcggtgaacttcgtgaaacggttcacatattcccacacgcggctattcgacgtgtggaacaggtgggcgccgtatttgtgaatctcggcgccggtttccgggtccatgtacgagtaggcgttgccgccgatgtggtcgcgaatgtcgatgatcgtgacgttcacgccgagcttctccaccgcctgctgcgcaatggtgaggccgaagattccggcaccgacgatcaccagatccggcgtcgcgttctgctcgtttgcagtcatctcaagtccttccgaaaatatcaatcgaacatgccgcatgtgcatattcgtcgccgcacaccacggaaacagtctgcagcgggcacttgtcaccagcataaaacgcggtgtgcacactgcggcgtgattcgcgaatgccaatgcttacgcggcctgcgaacgaaattcggcagcataagaagatgtggcgccgaacatggcacatggagcatatgcagacatgcgcgcggaatatgcacacagtattcatgcaatgcagccacggctcatggcggaacttcccccgccgtggtttaccataggttgcatgacacacagggaacgccgggagacgactgcccccttcacgctgctcatggcggtgtatgggggcaattcgttgcgtgaggtggagcgttccgtgcagtcgagcaccatcgagcagacgctgccgccgaatcaggtggtgattgtgcgtgacggcccggttcaggagccggtgcagcggtatttggatacgctgcagtcgaccatggcggtgtggttcaccgccgagcgccccgaactggaggtgcccgaggtgacgatcgtgcctctcgacgagaaccgcggactcgcgcatgccctcaacatcggcctgcagcactgcgatttcgacgttgtcgcgcgcgcggactgcgatgacgtgtcgctgccgaaccggttcgccacgatcattccgcaattcacccgccgttccgccgcctcgcacaccacggtgaagtcgaaactgccgattgacgtgatgggcagcgcgatccgcgaattcaccgacgacgagcgccagcccgggcagattcgcatgctgcctgccgagggcgccgatctggagaaatacgcacgcatgcagtcgccggtgcatcacccaagcgtcgtgttccgcaaatccgctgtgctggccgccggtggctacccggaggatgcgggcagattcgaggactacctgctgtgggagcgcatgatgctcaaccacgcgcagttcctcaacatgccggagccgcttgtgctctaccgcaccaatcaggaggcgtatgaacgccgtggcggctgggacatgttccgcgaggagctgcgtttgcagtggcgcttcctgcgcgacggtttcacgtcacccgcacagttcctgcgcaacacgttcattcgcgccgcataccgcatgatgcccacctccctgcgcaagcgcgcctaccattcgattgtctcgcgccgcaacaccgagatttcggccgcgcccgcgccggccgaagtgcaggccaagccgcgcggtcgtcacgcccagtccgagtgattcgcgattattcatatcatattcatatcaatctgcataatttgggacattttcagtgcctatctgtctctttttacgcagatgcgtacgggtcaattaccaatactctgcgtaaaaagagacagatggaggcccgcagatgtcccaaattacgcaggggatgactgcctatctggaggagcatgtctccgatgacgcagggaggcggagccaaagagccgagcctaaagagatttgaagaaatctaaagggagatgcgctcgatgtcgggcaccagcggcgggcatgcacgggcgaagatctcggcattcgactccggttcggtgtgccagccgtcacgccagccgtcgcgcaggcactggagaatgagggggcggtcgccggcgcgcatcacagtgagtagccagcggcgcgcggtcttcgcgaggaatgagagcaggccgccgaacgagaaatccgagcggcagaatctgagcatccagatcttgttgcgcacctcgttgtagaaacgctggcccgggtcggcgtccgacgaaccgaatttcttcgtcttgtgcacgacctcgctcgccggcacatagtaccccacgccattgcgcagcagagccgtcgtgtattcgaagtcgtcgttccacaggaagaacgcgctgatcggcagacgtcgacgcccgcgaatcgcacccatattgagcatgcaggagacgaaggagagcgagcgcacctggtacgcaccgccggccatctcgcgctcccccttcgccaggacggcacgtgggcggggtttgttcatcaggtgttcccggccgtcgacccacaccgccttcgacccgagtgccgtgggcaggcgatcgttcacagtgacgcattcgtctgcggcggcgagcagctgctccagggccgtcggcgtgggcacggtgtcgtcgtccatcagccacacatattcagcgattcccggttccgcggaaccgttggcgacggcgtacgcaatgcccgcgcagaatccgccggcgccacccgtgttctcgcgcagttcgagaatatatgcgggaatcggcgtgcgcccggcgaaatcgcgcgccacctgcaaagcgccgtcggtgctcgcgttgtcgacgatgaccagtgaatccggcctgcgggtctgcgcattgagcgcggacaggcattcgtcgagcaatccggcgcggttgtacgacaccaccactgcggtcactgaatactgcatacccgcaagtataggtgacgtatggtgacgtccactcgccatgcacatctcattcgcgtactgcttgtgaagacctcacggaaatgggcatcgctcggtttccatctcgcagagcgaatagaatactgatatttgtgtacaacgggcgcatatgccattcacttgccctaaaccgaatctgagaggattacgcgtgagcgatcaggaatatcaggccgagacgccgacaccggtaatcgacgcgcacaaatgcaccccgaaaacggtgtttcgtgacatctgcgccgcggtgaggcaatggtggcccacacgcccgaaatactcatatggcgcctacatggtggtgttcatgctcacctgcgtatggtccgattacatggcgctgtggagcatggattccgacaaccggtatgatcccggccatgggccgcttgtcgcgcagattttcaattcggcccacgcccggctctccacgaaccaggggtggatgaatctcatcatcatcgtgatggtctacattgtgctgctcacgctcatcaaccggttctgggcggccacggcggcaacgttcacactgttcgcggtgtatgcggtggcgaccgtgatcaaatgcgtgctccgagatgagatcattctgccaagcgatctcaacttcctcaccggcggcggcgaaggggacctgatgtcgttcataccggcggatctgagctcgatgatcgccccatccgtggtgatgatcgtgacgttcgtgctcatatgcgtcgcactccagttcctggacggccggagcatgttcatccattgctcatggcggcatgcgcttgattcgaagcggaacatcttcggcctcatctgccgcatcgtcgcgccgattctgagcatcgcactgctcgcctcatatgccaccggtctcgggcagcaggattccgcggtgcgacggttcctcgactatttcgagtacacgccccagcagttcaatacgacgtctgacgccaaccgcaacggtgtgctcacctcgttcctgagtctcgtggacgtcaaggcgatggagccggatccaaactacagcgaatcggcaatgcaggcgttgaacagcaagtacgcgcaatcggcgcaacggatcaacaccgagcgccgggccacactcaccgacagcacggtgatcaacgtgctgtcggaatcctacgccgatccgacgcgggtgccgggtgtctcgttcagcgaggatcccatgccgaatctgcgttcaatcatgcaatcgacgacgtctggcctcgcattgtcgcccgggtacggcggcggcacggcgaacatcgaattccagcaggtcaccggcctgagcatgacgaatttcgcgccgtcgctcgccacgccgtaccagcagctcataccgaatcgcccgacgttcttctctttcaaccagatgtggaacgcggcgtgcgacggttccaccgactgttcggtggcattccacccgtactaccagaacatgtacctgcgcggcgcgaactacacgaagttcggtttctcgcatttccacgcgctcaacagcaaaccgcagatcacgcaccgcgaatccaccagcaattcgaagtacacgtccgacgagcaagcgtatgccaatgtgctcgatgagctgaagcagccggattcgcggagcaagtacatcgagctcatcacgatgcagaaccacactccatataccgccgacgagtatccggataacgaattcatcgccgcggacacctccacggacgtcgccgcaagcgaccgcggatccatacggacctatgcgaagggcgtgcagatcaccgacaaggcgacctcagattttctcgaggaactcgatgcaatcgaccgcccgatcaccgtcgtcttctacggcgaccatttgcccggcatctattcgaaggccatggccgacccgaagaacgacatagcgttgcatgaaaccgactacttcatctggtcgaacacggcgagcgacgcgcatacgacgaagctcgacaaagcgaatgcggcccacacttcctcgaattatttcatggcgcagaccgccgagcatctcaatgccaaggtctccccgtacttggcactgctcaccgaattgcacgatgagattccggccatggcaaggctcgggcgcaatgacggcgagtggaagaacgattcctcgctgaccatgctcgacgcgcaggggcgcccgatcgacgagaacgacctgtcgagcaaggccaaggaactgcttgcagactaccgcagcgtgcaatacgacatgtgcgtgggcaaaaactacttggaaaccatgggcttcatggaactgccgaaatcgtagcgcatacgcggcaccacacgccgtcggcacggcgcacgacaattgtgacagcataattgaaaggttgaatgagcatgaagagcgttgcacggcacgatgggccacgtacacgcgcgcaacggatccgctgcgcaaaacacaggcgcgccaggatccgcgcggcatatcgtaggcatctgacatcgatggcagctggcaacacatacgccttgcatgccgcatcctccggcgaccccctcgcgatgcctgccgtggcgaaccatgtcaccgcacgcaacggagaccatgacaacgtgaagccatccgccgcccggaaggcggcgcatccccgtgccggcgtgcagaatgcggcccctcaaccgacaggggagaagaacagccgccgagtgaatccggtgacgcggcagtggcggcggttcaaggagacgaagttctacgaaatctggaacaaacggccgaagttctcctacggcgcctacacggtcgtgttcatcgcgatggtcattctggcgaccatgttcctgtggtggagcaccaacacgaaactcaaatacgacccggccagcgagctcaacttcctgcagcaggtgaccggagacgcctaccattacctgtcttccgcctcgtgctatctcaatatgatcgcactcgtgctcatctacctgctccttgtcaccttggtgaacagattctgggtgggcaccgcgttgttcggcgcattcgtcatggtgttcgcggtggccacgaaaatcaagatcacgatgcgcagcgaaccgatcatcccgtcggatctgggattcctgagcggcggtggcggaggcggcgccggcgacgtcgcgtcgttcgtcaccgacgattcgcgtccgctcgtcaatacggccatagcatggctggtatggttcgtcgtgatctgcgtcattctgcagtgtgtagataagcgccgcgcattcatctattgctcgtggcggcatccgattgcgggccccaagaacatcttcggtctcatctgccgtattctcgcgcccatcgtaagtgtgctgctgctcatctcgtacgccggcgtgctgtcgaacccacaggctccccaacgcaagacgttgtcgaagatcggctattcgcccacgctgtggaatgtgcagcaggatgcggagaccaatggcgcgctcaccacgttcctcagtctcacgcgcgtcaaggcgatggaggacgagcccgagtattcgcaggctgccatgcagcagatcaaaaatcggtatgcacaggccgccgacgagatcaacgcgcagcgttcgcagaatctcacggacaacacggtcgtcatgatcctctcggaaagcttctccgatccgaaccgcgtgccgaacgtgcacttcggcgccgacccgatgccgaacatccgcgcgcttggccagaccaccacttcgggcctcatgctctccccgggctatggcggcggcactgcgaacatcgagttccagcagatgaccggcctgaacatggccaacttcagcgatacgctgctctcgccttaccagcagctcgtggccacccggccgaagttctactcgttcaaccagatgtggaacgagcattgcggcgacgaatactcgacgagttgttcgatcggctaccacccgttcaagcagttcttctatctgcgcggcgtgaactacaagaagttcgggttctcgcatctgtacacgctcgacagcgatccgaagatcgcgcacggcgaggcctatgtcgggccgaacggcacgaagacggaagtgtcggacgaagaggcctacaagaacgtcgtcgaggagattcgcacgaacaccgagcagaacaagccgtcacagtacattcagctcatcacgatgcagaaccatgccccgtacccagatctctacggctccgagaacgaattccacggcgtgaacgaaacgccggacaccgttcccgaacgcggcatcatcgccacctatgcgaagaacgtgcagcgcacggacgaggccacggcaaacttcctcaatgagctcgatggcattgacaagcccatcaccgtcgtgttctacggcgaccatctgccgggcatctacaacacggcgaatgccgacaagaacaatgcactcaccttgcatgagacgaactatttcatctggtcgaaccgcgcttcggcttcccatgacgtgaagctgcccgagtctgatgccgcctacacgtcgtcgaattatttcatgacgcaggctgccgagcatatgaacgcgcgcatctcgccatacctggccttgctcgacgaactgcatgccgaggtgccggcgatgtctcgctcggtcaatgccggcgtatggagcgcgaagggcgaaccgacgctgcttgacgacaacggggaggtcatcgacaccaacacgttgtcgagcaaggccaagcagttgctcgcagactacaagatggtccaatacgacatgtcggtgggcaagaactacctgatggacatgggcttcatggacataccgaagcagtaaggtataactctatggcagtgaataccccgaagaaacgccagaccccgcgccatgcggcagccgccgcccagggcacgggcgactgggagacggtcaatcgcgttgtgttcccgacgtccgacgaagacatgacgatgccgttgtacgcaatcgaatggacacgtccgaaactcgacgaagacgtggtcaacccattcgcggacttctactcattggatttcggcgcaatgaacgagtccgagctgcgacggttgctcaacgggaacaaaaggcccatcgccaatgcctcggacgccgtgttcacagtgaccggtcgcacggcaatcacaatccataccggtcggcatgcctcgttctgcacgtatttcaatgcattcccggcaagctattggcgtcgctggacgccagtgcgatccgtgcgctttaccgcacaggtgaagggtgcaggcgcattggcgctcatgcgttccacgggacgcggtctcctgcaccccgtggagaccgttccgattgattccccgcaggcattcaccgaggtcagcgtggagatgggcatggacggactgctcgatggcggcttcttctggttcgacgccaaggccaccgacacttcggcgttgtatatcgccgacgcctgttgggaggtgcctactgcccaacggccgaatgacctgcacccattctcgattgcgatcaccacgttcaaccgaccgtcgtactgcctgcggcagctgcgtgccatcgccgccaacgccgacgtacgggcacggctcgacacgatctactgcaccgatcagggcaccgaccatgtatgcgaccaaccggacttcgacgagacggcggacgaactcggcacgcagctcacctacatccagcaagctaatctcggcggctccggcggtttttcacggggcatgtacgagacgctcaaggcaggcaccagcgcgcatacgctgcttctggacgacgacgccattagcgaacctgaatcgattattcgtgccgtgcagttcgccgattactgcaacacgcccaccattgtgggcggcggcatgctccacctcgacaaccgcacggtgatgtacgcacaaggcgagcgcgtcgacatgcgcgagatgcgcatgttcccggcagtaggtgccgaatacaaccatgattacgcgcagttcccactacgggactgccccaagctgcaccgccggttcaatgtggacttcaatggatggtggctttgcctcatccccaccgcctgtatgaaacagatcggtctgtcgatgccggcgttcatcaaattcgatgacatcgaatacggactgcgcgccaaggagcatggattccatacggtgagcctgccgggcgtcgcggtgtggcatcaggcatggcacgacaaagatccgggccgcacatgggaggagtatttcaacaaccgcaaccgctgggtgtgtgcattgctgcacgccgaaaagccaagcccgatcatggcgtaccagatggcctacggcgacgcgaacctggggctccgcttcatctactcgggaatcaagctgcggcacattgcactccgtgacgtcatgcggggcccccagtacatgctcgacaccgtgcacacgcagctgaacacggtacgcgagctgcgcaagggattctccgacaccgatctcaaaccgaatctcaccgatttcccggaggccaaggccgagttcgagccccatgccgtgccgaagtcgaaggccgcagtgcagaaggaatgcttcaaggtcgtgctcaaatcactcatctcacgaaccgacggcacccatgacgaacgccccgccatcgccgtccccgccaaggatgccacctggcacgccttccaagggcaatcctcggtgcttgtcaccagtgcggacggcaactcggcatcgtggtgcaggcgcaacaatccgctgttccgcaagcagttcatgcgcggcctgtacctgtcgaaggagttcttcaagcgctgggatcggctcgccgccgagtacaaggccgcaaatatcgccagcgtggagcattgggagcagatcttccgcaatccgcggtgacagcacgacatattcacagcgtggccggtgtttcatgtgaaacgccggccacgctgcatatgcccgtgtgtgcagatatcgcgccactcactccacgtcgaagaaccgcgggtcgaacacgctcacatcgacgtcgccggtcacgccgggcacacgcgcggtcgacgtgtattgccatgcgtgcagatccgggcagcctgcgaaatcatactcaagcgtgtcagaatacgaggcgatccagttggcgtgtccgtgcagccagtcgctgtcgaggcgcgtcgccatgttgtgcgcgtaagtgtagattcccagattcgtgtaccccgcatcctcgagcacgccgaagaacaccttggcaatctgttcgaactgaatcggccgcgtgggcatcgtgtgccctccccagtcgtcgaggtgctccatgtcgtagaaaatagggacgctcttgtcggtgatcgaatacctcctgagcgtttgcagcacgaaattcgcctcttcgcgcgcgaaatcggtgtcgtaggcgtagctgtacaaatacaggccatgcggaatgcggttcacgcgcacttgggccagattgttcttgaaatacttgtcttcgttgccatggccgtagccgatgcgcagaatcgccgcatcgacctcggattgcttgaccttctgccaattgatgtttcgctgatgttcggcgacgtcgatgacccgccataccggccgcagcacgcggccatccccctcggtgaacacatgtacgccgaacgaatacgaccacgggtcggccgcctcgttccatgcgtccgcctgatcgctgccattcacattgccgcaaccggtcaacgcgaacatggcgagtacgcagccgagcaatgcgcaaaccgcagtcttcaatcgccgggcaaccctgcggacggcgtttggattgcaccatcccccgtattcgtgcaatccaagccccatccgcatcgtcactcctcacatacgccgaccccttgtattgtaggcgatttccccgggcatcatgcatacaggatgaaatgcagggcctccaactacaaacgagcgtccaaacggtgcagcaatgccaccatgtcctgacggtacatatgccccataccctcgtaacgccatgtcccgttgccattgctgtaaccttgcgaaatacccgaacccccaagccactgcacttcctggtaatgcggtgtactcgcattcacatcggtgaagctcatcggtcgcacattacccagcttgttcgccttcttagccaggcgatacaggaaggcagccatgtcctgccgatacatgggtgccatgccttcataccgctgggttccattgccgttgtcgtatccatcggcaataccggcatgggcgagccacagaatgtccgccgcatgcggcgttccgggatccacgtcggtgaaccggttccaatctgccgccgacggcttccacgtcttcgcgcctgctatgttatgccgcacggccacacgacgcaggaacgccgccatgtcttgcctcaccaccgtgttcatgccccggaacgttccattggggaaaccgtccgtcaccttggaggacttcgcccatgcgatgtcttgcagatgcggggtcttccagttcacatcggagaagatgcgctggtcgaaggcactcatatccacgttgccgctgactcccgagatgcggtcgatcgaggtgtactgccaaccacgaacgtcggagtacccactgtggaagtcgtagctgagctggtagctgtactgcgccatccagccgatccgggctcgcagatcattggcattcaggcggctgttcgcatagttgaggtaggtgtacaggtatgtacgtccatagccagcactggcgagctggttcacgaatgcgttgatgatcgggcggaacgcgttggcgttggtgggcatgcggtgaccgccccaatccccctgctccacatcgtagaacaccggcaacgccatatcggacgggtttacaccgtacttgcgcaacaactgcacgacccactggccttcctgcaccgcgaagtttacgtcataggcatagctgtagtggtagatgccgaacgggatgcccaagcggcgcacttcctgcagattccgcctgaaatggccgtcctcgaagccatgaccgtagccgatgcgcagaatgacggcatcgacaccggaacgcttcacccggttccagtcgatgaccttctggtgttcggaaacatccagcaccttcatggccggattgaacaccttcttccccgcacagttctggcccgttcccgcagaggagaaccgcttgtacccattcgctgtgtcccagtcgtacagtgcggaacagccggcggatgccttggccctgccagcgccctgctgctcgcccttcgcctgttgttccgcttcccattgctcctgggcggcgccttcctgccacatgtgctcaggatttgtaatgcctttgagctcgtcgggcatctcgccttcgccttgccactgtggctgcacgtcggcggtctccgtggattccatggtctgcgtcgcggctgcatccggcgccacgctatcgttcgcccacgccgagggtgccgtcactgccacggttgtgcacatcgccacagtcagcagaccggcgcacacgcccttcgtcatagtccgcactcgcagtcccatccatccactccttcacaccgcgaataattcccaagtcatctgggtttccaccgcttattgtagagggaacacgcgtcctcatcagggctgcacgaatatccgctcaatgtatcaatatttggcatataggaactaaacgtgttgtttatcttgctgctcatatcatatggcagtaggcgtgtcgtgtgttctttattgtgccgtcccgttaatacggcgtgttttccgtggtgtggggtatgccgcgggcatgaggaagaaatcagtcagggcgcgcaaatgcccggtgtgcggcaacgcgatgatcacacacggcaggagcgcctcgggcgctcaacgacggcgttgcgccacatgcgcgctcactcccacggcgtccagggccgacaaggcgcgtcggtgccagctggacgagttcctcgactggctgctcggggccgcgccccagcgccggcggcgtgagagcgcgcgcaacttccgcaaacgcgtgggttggtgccggggctcgccccgggcatcgaacccgacggtgtggtgcatcatacggtcatggccgacggcacccacatgaacggctggtgcctgctggtcgcgatcgacggcgaggacggcgaggtgctcgcctggcagtggtgcgaccgtgagagcgcagccgcctacaaggccctgtccgaacagatcgcacctcccgacgtgctcatctgcgacggcatgaaaggcatcggcaaggcctgcgccgaggcatggccgggcacgcgcatccaacgccgcctcatccacgtgcagcgcgacacgagggccgacctgacctccaggccaaggctcgaggccggccgggagctcaagggacccgccgacgcgcccgcccgcatccatgaccccgaacacgccgcccggtggggcgaggcgcccgacgcatggcacgaacgctggaagacgatgctggccgaacgcaccttcgccaaggaccatcccgacgatcccagggcagccacaagcacaagcggatggtggtggacccacctgccgctgcgccgcgcctatcccaggctcgaacgcctcttccgcaacggcaccctgttttgcttcctcgaccccgaattactcgaacacgggcccgtcgcccgcgacagcaaccggctcgagggcggcgtcaacgccaagctcaagctcatgcttcccaaccaccgcgggctcccaccaaaacacatgagacgcgcctgtgaatggcactgccacatgaaaagcaacgaccccgaccccacgcgcatcctcaaggaacacgaccgcaagagcaaaacgaaacaagcagccccacaagaaaacgacatgccccaaccaaccctcggcaccggcatcgactggaacgaattccacaccagcacacgctacccaaacagcacggactagaaacctaaaacaacacgtttagttcctatatgccacattttgaagttttgcgactgaaaatggaaggcagcatgacagagcatcgttcttagctctgcggcaccagagagatcagcagaaaggactatgatgaacactctcaaaaagatggccgtcagcgctgtcgccgcactggcaggcgtgatgatggtggcgccgacggcaatggcagctaacggcacgattccaattgatgcagcccacttcccggatacagcattccgtgtacgcattgcacaggaattcgacagctatcccaaggacggcaaactcaccatagcagaacgcaatgctgtcaccgaaattcgtggcggtgacagctatgagatcaagttcgcaaagggcatcgggtattttccaaccctcgaaaatctatatttgtacaaccagctcttgacttctatagatttgagccacaacgcaaaactccagaatctgaatctctcccggaataagctgacgaaaattgatctcagcaggaacccagaactgcgcgacctcgatctcagctcgaacaagctgatctcaatcaatgtaagcaaaaacaccaaactcactgaattcgattttcagtccaacccgctgctttggataagctcgatcgcccctgcggtcaatgtcgatatctatagccccttcaccgattaatacaagactcaaagcggcatcctaaatcttaaatcggctgccccgagcattgatctctcgatgatttcaaatgtgcgtggcggaaaaatcgagaatggcgtcgccatgcccgataaacttaacggaagcgtcacttatcgatacacctacgattacactcatgagcctttgaaggcggagattacattcacaccttcagtttggttcaccgacgtgaacgtgtattccacacctcatgcggtggatatccagtggctggccgacaacaagatcaccaccggctggctggtgaacggctgttatgtgttccgcggcatggataacgtcaagcgccgggacatggcagcattcctgcaccgattggccgccaaggcgggcaagggcacgaacgtcactccgaagaacaacttcaaggatgtgaacgccaagaccccacatgtggccgacattcagtggcttgcaggcgccggcgtcaccgaaggctggaaagtgggcaactcctacgagttccgtggcatgaacaacgtggtgaggcaagacatggcagcattcctgcatcatctcaacgacaaggtgctcgccaggtgacacatcgccgtcactgggctactgcgggctgcagtcaccagcacggcatatgaaacgtccgcacggctccgagtttaatacgacactcgaaaccgtgcggacattccatgtcaactcattgctcgctccggttacttatgcagggcgacactcatgcattgtcgcgcacgagcacaatcacatcatggttgatgcgatccgtttcctcatctgcaagcatctcatcaatggtcatccacttgcaacgatgaccgccgacgtcgaacggcccgtcaacagaccaagaatccggcagcgcggagacgacccctcggtagatgcgataatcatagtaccgcatctcatcatgttccgtcgaatacttggtgctctctccgtccgtcttgtattccagcgtgcaatcgtcttgcggaaccttgaattcggcatgaagatagttgcgaaggtcccgctcgtcatccggaacactcggagtggagcgacggttcgggaagaaccagcacttccatttcgtgtcccaatacaccagatatttgttggaatcggagatgccgggctccgtgattgcgattatcgagctggcgatggcattcattccggcgatctccttgaataactgcttcgtggtgtaaggcttgcgaatgactcctgcaatgccatatatagtaacaatggccccaagcacgtacattggaatcttccaccagagatcttccatgaccactgcagatgccacatagaacacacccgtgatgatcgtgagcgcactttccaaacgcggggcgatgccgataaagttgcggcgattggccagcaccgtctccaagtcgttctcgcgaatcatcagcatcatgcgtcaccatcttacaaagttacagactcacgaacgaatgtggctcgccgtagagcggggcgacttgggcgcgaatctggtcacggtatgcgaaccgcaccgacggatcagcgaaaccaggtcccggtttcggaatcaacgaatcgcctatggtagtctgcgtccaacgggagcccatgcgcagcacggccgcatgcttgacgtcatagtaaccgggtttcaccggtatgaacgtgccgctgcaaccgcgcgctgccgccagcaggtgcggatgataccgcgtggacagccaccgctgcccggaacgcgccgggaagccgtggtcaatcaggttctgcagcgggaacagcacgggctcccatccatggtcgcgaatcacacgcaatgcatccatcgagtcgtacggaatgcattccacaacgcccacgcgctcccctgccggcgcttcccatgcctggagcaccgcgaccatatggtccagcaaagcggccggatcgggcaccaagtccgtttgcacgcaaaccatggtctcggggaggtctcccgccgcctcatcgggcaggtacacgccctccaagccattgacaaagcaatcgtcgggagccagcgtggcgtatgaatgcgaggaatctatggcatcgagactcggcatatcacggcatgagaatgcagtgatatgcgaggcgatatcggccacccattccgcatcttcggcatcgagcggctccagtcccacgccactcaccaccgcaggcttgccatgcgcctgcgcccatttcgccacagccagacgcgccaaattcgcattccagaaactgtgcatatagccgccgccaatgacgtgcatgtcaagcgcacgattgttcagcaaacgaatgcctgcggcataccgggcatccaacccctcggcatccaacgcggcgagaacgcgattcgcaatctgcggaaccggaatctcctcgatggtgggagcaacggcagcagccggttccacggaatcggagacggcatgctgttcatcataaatatgagcgcgatcgatcatgcacatctgcgcaacggtgtccaccacggagaacttcgggtggagccccgagcagattgccgcagccggcccggcgcacaggcagtcgagcaccacaggcacttcggggtcgacctgtgcgagatacttgacccattcacgcgcaatgagctcgtcgccgtagttcgggtaaccggcctcaccgatcaggtaatggcacttcgatcggcgaacaatctcggtttcgggcagtggcttgacgccgtaatggcggttatacaggcgtgtgatctgctcccagaacgctcgcttcgcggccttcaatgggcctcccgacccgctgccgctcacgcctgcccactttcgaagacagtgttggcatcggccgcggtatcggcagtctccttgcgggcggccttctgctcggcggccgcgtcttcggcttcctcctcactgatcggcttgatgtagagtgcacggttgttgatgagcgcatagttggagttgcgcgggtcacgaatcgcgaatgtgcaggcgttgtcgtccaatgccacagccacggcatccgtcatcttgccatcgccgggtgtgggcgtgcgcagcgatgtgatgagccggaactcgccgttgttgaacagatcgagcggcatctcgaaatacacggtatggtggccgggcttcgtcatgtgcatctgtggattgcgcgcaccggtgtcgaaggtgatgcctcctcggcgaacatcgtgcaacgcgatggccaggtagaagtcgtcggtctcgtcgaactggtattccacggcaaaccggaacgtatcagcactggtgagcatgagcggtgagacaccataggtgcgcagcagcgggcaccgttcgttgaggccgttcgggtactcctcatgccccgcttccagcgccttgcgagccttctcctcgttctcctggtcaatggcctcgagattggcgagcgtgtagctctccgacacggtctcgcgatcgcctatcgcggcaacctcgccgtccttgatgaacattgcgcgcgtgcagtagcgtttgatcgcactcatgtcgtgcgtgaccagaatcaccgtcttcgtggggtcctgacgcaccttggtgaagtaatcatcgcatttgcgttggaatgcctcgtcacccacggccagcacctcgtcgagcacgagaatgtcgccctgggccttgatggccaccgagaacgccaggcgaacctgcatgccgctcgagtagttcttgagcttctgatccatgaactccccaagttcggcgaactccacgatgtcgtcgtacatcgcgtccacttcctcgggcgtgaaaccgagcaatgcgccgttcaaatacacgttctcgcgaccggtgagctccgggttgaagcccacgccgagctcgatgaacggcacgagtttgccggtgacgttcactgaaccgcggttcgggtagtagatctgcgagatgatcttgagcagcgtcgacttgccaccgccattgcggcccacaatgccgaagaactcgccctgatgcacctggaatgtgacgtccttgagcacctgctgcttcttgaaacctttgatgccctttgtccagttgatgaacgcctgcttgagccccgtggcctgttcggtgggcagcttgaaccatttgtccacatgctccacgtccaacaccacgggcttgtccatgtagttgtcgatcgtgacgacgtcgccgttctccacggcgtcggtgttgtggtcggttgcctgagtcattacattacctccgcgaatcggcggctgttcttacggaagatgtacacaccgaaccacagcagcagcacggtgattgcgatggggatcatcttcacccaccaggagccgaaggtgttccagacagtgggctgcgtagccggtgcaatgaaattatggcgaatgtcttgaatcgtctgcgcaatcggattcatcagttcgagattggcgatcgtacgatactcggggtgcttgtcggtgatgaagctcaacgggtagatgattggcatcgcatagaagatgatctgctgcagcacttcccaaatatggagcacatcgcggtagaacacatagaacgtggacagaatcagcgcgagcgcaagcgcgatgatgtacagttccagcacgtttattggcagccagagcacccgccaagtgaactgcacgcgcatgaagatcgcgaagatgagaatgaccacataattgatggcgagcgagatgagcgagccaatcgaagcggagacgacgacgatgtagttcgggaaatgcactttgcgcagcaggtcgccacggtcgacaatcgagcgcaggccgattcccacggtctccgtgacgaactgccaggagctgatgccgagcagcagcacgactgggtaggttggcgtgccatccgtcatacgcatgaatttcgcgaacaccacatacatgaccgcgaacagcatcagcggcttgagcacagaccatgccacgcccaggaacgacccttggtagcgcatcttgaaatcggtcttcaccaggccgcgcaatacggtcatggcatacccgtagcggcttttcaaccgttgactcagcgtattcactcgcaccttcttcgtttcgggttcagtcgctccattgtacctatgccactgttcaagagcaccgcaatgggcgaatccgcaacgaatggcatagaccgcgcgcttgtgcctagaacatgctttttcgttcgcctgactatgctggaactattcgatagtcgtagacataagtgaggatgcatgccatcgattcgatttgcgaacgtgctgctggagaccaagccgcgcgcgctgagctacccaacgatgtattaccacactgatcagctgatcaccccgtccggcgagaacggcgagtggacgatcaatggcgccggcaccgtcgatttcaccacgtatttcaacgcgctgtccgtgctcaaattgcaaaagtacacacgcgcgaccggctttgcgctgcatatcgacgtgaaaagcgccggcgaggtcacgctcacgcagacctgcgccgagcgtctgtcgatgaatccggagattgtcaaagacaattcccagactgtcgccggcgacaatgactggcatacggtgacgctggacatctcggtggacgagcacaccgtgctggctggattccagattgccacgaccgccgccaccgagattcgtaacggctactacgaggtgtcgttcgacggtgagccgcgcgatgtggaactgtcgattgcgacgacaaccttccgcaaggagaagttcatcgagcgcaacatcgagctcgtgaagaccgagctgctggcttcggattacgacattgccaagcatttgaccatgcacgtgatcgacaatggcagcacgctcgatgcggccgccctgagtgacgagcatgtgattgtgacgccgaacgagaatgtgggaggcgccggcggcttcgcacgcggcatgatcgagtctctcgagcagagcacccctgcgacgcatgtgctgttgatggacgacgacgtcgaggtgtcgccggagagcattctgcgcacttacaatctgctgcgcatcgtgaacgacgagtatgccgaggccttcgtctcgggagcgatgctcaacatcgaagacacgcaggaccagaaggaagacaccggtttcatctccacctatgatgggtcgtgcgtgcccgccaagccgccgctgcaagtgaccaagttcgtcgacgtggtatacaacgaatgcttcgacgaatccgtgtgcgtgcccgaggacgcccaccgctatgccgcatggtggtactgcgtgatcccgaccaccgtgatcgagcgcaacggcctgccgctgccgatcttcgtgcgtttcgacgacgtggaatacggcatccgctgcaacccgaagttcatgacgatgaacggcatctgcgtgtggcacgcgaagttcgacattcgctacaatgccggcgtggagcgctaccagacggtgcgcaaccagatgatcgggcaggcggtgaccggcctggcgccgagcatgaagacgatgctccacagcctgcaccacatggtcgatctcgaaagccgcaaattcaactacaccgatgcggagctcgcgctcgatggcttcgaggacttcctcaaggggccgaagttcatcatgcagccggtggcccaagagcgtttcatgcgggcgaaccgcgagaaggagaagctggtgccgttcgacgagctcaagaagcaggcggccgagatgggcatcaccgacttcgacccggacatgctcacccgtcaggtgatcgatttcgacgaaccgcgttcgttccagcagcgggtgttcgatttcgtcacgaagaacgggcagcgcttcggcaccgacaagctcgtggcgatcaggttcgacggcaggggagacgaacctgagaccgcgctcggttccgacggcgaccgtgtggaatacaccatcattccaagtgcgggctggctctaccctgccggcatgatccacaacgagaatgtgatcatcgccatcgattgggccacccgcaagggcgtcattcgagtcaaggacgccaagcgctacaaggaggtaatgaagcgctacaagcgtgacatggcctactacaagaagcacgcggaccgcctggcagccgagtatttggcagccggcccgcagatgcagtcgatgcgcttctggaagcagtacctcggcatggactgatgccacacggcgcagtcggtgcgatcgtaccccgactgcgacacgctggacttgtgacttacgtgagcttgttgtattctatttaagttgcgtaagcacactggaggattcgcctagtggcctatggcgcacgcttggaaagcgtgttggtgtaacagcctcgcgagttcgaatctcgcatcctccgctcttcagccggaaccttagggttccggctttttcgatttcagcggcagataaatacgccagatagcaacgcatcacgttgtcggcgacgccatatcgtgggatcatgcggtcattccgatgaaccagttacgcaccgtggtatacatgccagtgcgtaccgaagcaaactccgcaagccgccccttggcgaacaggccgaacagattgatcagcatcgtgaagaacaccagcgcgacgagcagcgttaccaacgtacggaaccccaatgagtcacgaaccgcgaacggaacctcatgggacttggccaaatccagcccttcagactcgattgccccctgctgtatgccagagtcgaaggcgagcaccacgagcagtgtggcgagcatgaaatagaaggcgtagtcgcccgagtagcgcatcgtggtgccgcccttgtagcagtcaaacacggccacgatgaaaccgacggtcatcatcgtgcaggccagcccccacaccttgtggtcgcgcagttggtaccgcaggagtatgaacagcaaggcgaacagcgccagcgggtacacggcgaaataaccgccgatcgacggctcgttcggtgcagccagcgtggtgtccaccgtggtaatgaacgggaagcgcatcgtcgtggccaccggttcgaacagctggttgaatacctgccccggcagtatatagaggggacttctgcgcgtggtgaggtcgaaaccggtgaaattgtagttctgcccgaagttaagccacgcaccaaagcgaatatggttgtaatacagcagcggaaccgtcacgagcacgaacgggagcagcgcggccgccgtcccccatgcgccgcgcttggagaacaacgtgcggtgctgggtaatctgctcccagaacagcgggaatgccagcagccaggcggccgcgaactgcgggcgcgagcccagcagcaacgccatgcacagcgagccagcaccgatgagccgaccattgaccgagccgtcgtgccgttttgacacctgccagaaccacaggcccatcagcacgagcgcgatcgcacagacgatgggcacgccatagaagttgcagctcatgttgtatacgaacagattcgtgcctatgttgaaaccgatgatcacgagccatacgacgccgagcgaggccttcggaaaatagtcgtgtgcaaggcgacgcaccagcagcgtgccgaagacgacggcgagcgcggagaatattcccatcgccacccaggtgggcatccagtggccggtgatcaactggtagggcacgaacgtgagcaatgccgggaccacaccgaaatagcagtaatatcgtccattgaaatatgcgtggtcccatatgaactggtggccgtcgcttgcagccagaccacggcgcgcgaagaagtcgtacggattcgccatcgtctgcaataccggatcgaccggcagatcgagccacgtatgcccatggatgagtgcgtccgccagccgttggtactgttcatgatccacataatggcccgttccggcgtcatacccccacggcctgggcatcgtcagcgcggcgacggccacaatgagcgcgctccatgcgaccacgtacacggtcgtggccgaccgttgcctgttgctgtgcaggttcacatgcagccggtagatcgctgaacgcggtctgaacacgacgaagaacgcggcgatggcgatttcaagcagtaatctgaacggattgatttcaaatggaatcgtgggattcgcgtacacgcggtcgaagatgaccttatgacccttgtctccgtagaatcggacccgaatctcggtggaatcgtaatactgcagtttcttgccgatcagcaggtactggctgctcggattcgtcgtatagtgcagttcgttgcgcgggtcgccccacacgccgtcgctgtcgcggctgctgacccactcgtttccggacatggtgcgtccgccagtcgtacggagttcgatcgcgccgtcgacataccggttctgttggtattcggtgttgttcctgttgttcggcgtggcctgcacacgtacgctctctacacgcaccggccctcccccgtcgcgcgcgctgactggcacggtgacggtcgccgtctcgggatcggtgatctcatactcgttgtttccgagcgacttcaggccgcggcctatgactggctcgccaaccacggcctgctgcaggccggttgttctccagtgccccagattgaagagccctacttcgaagaacgtgacgatgacgaccgcgacggcgatggccacccaaagcccgcgcttcgatcggacttgggaatctgtaatctgttccattgttttcactcccctcacgccgtcaatccgatgaaccagctgcgaacggtggtgtacgtgccgctgaaggtgccgtgccaggcgtcgagtctgttctcgttgaacaagccgaacagattgatcagcagtgtgaggaacacgagcgtcaccagcatcgtctgcaatgtgcggaagccgaggaaccgattcaccgagaatcctttggcgtgcagattcacggcaggcctgtgctgcgcggccgtggcatacgcgagcacgacgaacagggcggagagcatgaccagataggcgaaatcgccgtaataccgcattgccgtgccgcacttgtagcagtcaaacagggcgacgacggcggtgagcgccatcatcatgacggtcatggcccacaccccatgcgcgcgcagttggcgacgcaccagaacgaacagcagtgcgaacagcgcaagcgggtagatggcgaaataaccgccaatcgacggttcgttcggaccggccatcgtcgtgtccacctgcatgatgaacgggaatcgcatggccgtgtcgaccggctggaaccactggttgaacagatcgggcagcactgtatatggcgaactgctgcgggtggtcatatcgaagccggtgagattgtagttctggccgaaatcgaacagcgagccgaaccgcacgtaattgtatgcgagcagcggcggaatgacgagcgcgaacggcacgaacgcggcgatggtgggagccagccccttgcgggagaacagcgtgcggagcttggtgatctgcggccagaacaacgggaacgccagcaaccacgcggccatgaactgtgggcgtgaaccgaaattcagcgccatgcacagcgagccggcggcgatgagccaaggattgacggtgccgtcgggccgtttcgacacctgccagaaccataggcccacgagcgtcacggcaatcgaacagttgatcggcattccatagaaattcggactgtagacgtagacgaacagattggtggcgacgttgaaccctatgatgacgagccacacgacgccgagtgaggccttcgggaagtaatcgcgggcgagacggcgcaccagcagcgtgccgaatacgacggcgagtgtggtgaacacacccatcgcggcccatgtgggcatccaatggccggtgacgagctggaacggcacgaaggtgagcaatgccgggaccacgccgaaatagcagtagtaatggccgttgtagtaggcgtgatcccaatagaaggtgtgcgtgccgtcggcggcgatgctgcgacgggcgaagtagtcgtagggattggccatggtggtgagcgcgggatccaccttgagatcgagccaggtgtggccatggatgagggcgtccgccagccgttggtattgctcgtaatccacccaatgcatgaaaccggtgttcagaccgctcggtttgggcatggcgaatctggcgatggcgacgatgatcgccgaccatgccacgacatagccggcgatggcgaggttctgcctcacgcgccgctcatcgacccgcatccggtagatgccggaacgggggcggaagagcacgaagaacgcggcgaatgccagctccaccagcagtcgccacgggttgatctcgaaggggatcacaggattcgcgtgaatgctgtcgaagagcacgaaatcgcccttgtcgcccaagtagcgcacgcgaatctcatgtgagtcgtagtactgcagtttcttaccgaatatgaggtattggctggccggattcgttgtgtagtcgagtatgttgagccgatcttcccacacgccgtcgctgtcgcgcgaatccacccaagtgttgcccgaaatggtctggccgccggtggtgttgagttgaatggccgctcgcgaataatgattgcgctggttgggcacttcattcgtattgcctggcgtggcctgcacgcgcacgctgcctatgcgcaccggcgcaccactatcgcgcgcgcccaccggaaccgtgatggtcgcggtctctggatcggtgatctcgtattcgtgatgccccaacgatttgagaccttcgccaatgatggcatcgcccacggtggcagcctgcagacgactggttctccagtgaccgagattaaagaagcccacctcgaggatcatcacggcaacgaatgcgatggccatgctgacccacagactgcgacggttcccgccactgtgcgtcgcagacgccgtcacgctcccgtgtggttgtgcctgactgaccggctcgcgcatggaaactcctccaccatgttctgtgttcggtttgcgtttctcagggtacccgtacagtgtaggcaacgcgaatgagaaatttcacatagcatgcgagaacggccggatggccggccccctgccattgagcagtcggaactgcatgcacgggccgcaggccggcaaggcaccgctccaccgcggccagcccggctatgcgccgaagctcgaccgcgacggcgatggcatcgcttgcgaatgatgctcgtcagcacgcccgcaagccgcaatgggtgccgtggcacggctcattaggccacgacatccacgtcaatgatttccgcgtcaccggccgcctcgcccagtgcatgttccgattcactgtgtggggcggtttccggttccttcgcactggcgacgatctcggcaagctccgcggaatcgacatcgccgtcgtcttcatcttcgaaatacggcatgatcaaccgcgcataggtgcccggatggtcgttgagcacggccatggccagttcggaattcaggtcgtcatcgtccacgaacacgcgttgcagcaccaccgaagccatgtcggagaacacattctcctggaattgcgacagattccagaaatcggggtcatcggcatcgcacagcccgaaattcccgccgtcctcaatctcatgctcgaaccgcaccaccacctgcatgggcagcagggccaccgtgaggtcgcgcacatcgtcgcacagatgcccgagcaggcgcacaccctcctcgaattcctcgcgattgcgccgttcaaagcccatcgtgatcttcgaacccattgccgcacccatcagcgacaccgtgagatcctccaaatacagcggattctcccataatggcaccgaaggcaccgcattcgtctcctcgagcattccgctcagcatgcgcgtgctgcgggtctgcttgttccacaacgcacggtacgcctccaccacttttccggcgtcatacaggtacctgcgatccatggctttcgtggcagccgcatgctcctcgacatccgaggcgtcgtgctcgtcgatcaacgcatgcgcatactccaggtcggcctgcacacgcaatttgcgtcgataccggatgatgcgccggaaccgcatgtcggtgctcgcacccagccgccgcactgttttgtcttcacgtagcatgcacatgcccaacccccagtcgttgagtatcaacgtcgccagttcgcgccgcctctcccccggttcgccccatttcgccacgcaatacgctgccaacatgtaggtgtggagggaatggacgcggttgtagcattcgcgttgccacgttggcccggtcctctgcactgtggcatccaaaccgcaccgcaatctgccattgaccacatccggcccgttcacgatcaccggcatgtgttcggcgggcttatgcagcagcagagccatcgaggcatcgttcatgatgtcgtacaaccacaccgccatgccatgcctgcgcacggtggacgaacagtacagcatgaatttgcgggcctcgtcgatgaggtcgtgatccaatccgagcgatgccatgcgtatgagcgacccccaatgcgtggggccgaacagatcctgcgccagcacgtcgatgcgacgatccacgcgactgaacaggtccatctgcgcctgcacctgcgccgacaccgtctggcacatctgctcattctcggcacgttccggcgttgcattacgccccttggcagccgagccgcgcctatggaacgcccccgtgcgcctgttcgaagactccgtcgaggtatgtggttgtatggtgggtgaatcgatgcggtcgaaactcaggggagcgtgggagaccacctcatcgaatctgcgttccagctgattgagcagttgcaggaagccgatcgaatcgaacgcgaatggttctggcatgcaatcctcttttcctaaagatgcggcgcccacggtgagcgctcgtattcatacactcgcataggtgcacagagaatttctcgtatccacaaaaatctgtggacaagtggatgacagagtggatatccacggggataacttgaatttccaccgtgaatatgtggacaatgaacgtcgcggtatgcacattgtggacgacctgccatcacaatccaccatgaactgtgcatctgttgtggataacccagccgcgaatttcgcctcacagcattctcatagccgggcttggaaatatacttactcaggaacgcacaaggtgcatgaatacagattgcggggtactatgttcatcttcggccaagcttggaaaatgctgtgccgccatccattgaggagcctgctcatcgtactggtgagcgcggccatcgccatgtggtccacattcggaggcgcagtgctgcaggagaaccacaaggcgcgcacggaaacactcgacaagcaaagcaacaccgccgtgatccgcccgtccagccagctgttggaaacacgccaaggcgacgactcctcctggaccgaacactatctgtcttggtcggactacgacaagctcgcctccgccgggcaaacgcaaggcatgcaatacaaatacacggtggccgaaagcgtccccgtgcgcgaaagcaagtcggtgcaggcaatcaccacaggcaagacgtccgatgccagtgccgacaagaccggcggcaatctcacactgcagagcttctacacggccgaagccgcacaggcgaacgaatacggcccatacgaggtggtggagggcaaagggctcgactaccagaactccctggcgcagaacgtgctcatctcggaagcgctcgcgaagaagaacaacctcaaagtgggctccaccatcaccatcggcaaccccaccgatgcgaagaaaacctatgaatacacggtggtgggcatctaccgctacaccggcaaccccgacaacgcgcaaggcgacgacgccaaattcgccaaagacaaccgcaacaacgtgctctacaccacgtacaccaccttcgccgtgaacggattcgacaccaccaaaggcaaaggctggtcaatcccggacctcaacgtcgtgttcacgttccagaaccgcagcgacatcgacaaattcgccgcggcgctcaaagccgacctgccgaagggcttcacggtgagctcgcccacgatcacccactacatgcagtcgatcgaagcgctgggcacgcttgccggaaccactcgcatcatcatgatcgtgctgtggatctgcggcgcgcttgcactgctcggcctggtgctgctcgccgcactcccccgctctaacgagatcggcatgggcatgctcgtcggactcagcaagggacgtctcgcatggcagttcatgcttgagacgttcatgccgacgctcgtcggcctcgccgtgggcttggtgctgggcgcatgcaccgccaacccgctggcaggcgcattgggggctcagcatgacgttcatgcaaccggtggcctcgtatggcaggtgatctggatcggcgtgctgtgctcggtggcgctggccattgtcgccggcctgcgcgtgaccttcttccgcaccattcgactcttcgagtcgccgtacatctccgattccgcagattccgaggactgacatgaccgaacaccacgattccaaagacacagattccaaagacaccccaaccaccccgcaggaaaacgcctccgagaacgccgcacccgacaccttcgactatgtggtcgattactgggacgacgagggatctgcaagcaacgactcctccgacgccgtcatcgaggcgctgagcgcgaccgtggatgcgaacgcaaccgatccgaccgatggcgataccgatgccgacggagagcctgccgcagacaaatcacgagagacggctccggcacactccaacgagaacgcgcaagtcaccgtgccggatgtggtgcaggtggcagaccatctcgactcgtcactgcaggccgaggaagatggcgaagacgccgcgctcgccggatcctcgatcttccgcgcctaccccatgctttcgctgcacgatgtgacggtgagcgacccgaagacgaaggagcacatctggcagcatctcaccttccgttgcgaggccggcgaatgctacgcgatcatggtggacgcgcatgacacgcgccgccatgccacgctgctggcgctcatcggcggcttcatcgccccatcaagcggtgagatcatgacgaagaccaccccgtacgaagacatggacgccgagcagctgcgcggtcatcgtctcggcatgatcacgccgcaattctcgctgcgcggcgatctgaacgccgtggaaaacctcacctacgtcatgaacgcctccgggcagacgttcatgaaaccagtgaaggggcttgcgcaagacctcctcgtgcgcacgcggttcggcgagaacacgaaggcggacgaaagcaccctcgccgacgaactcgacccggtggatgcggccagactcagcatcgcgcgtgccttggccatcgacccggactacatcatcgcagacaacctcaccgtcaatctcaacgagaccgacaccaagcaggttctcaacctgctcaaggcacaggtgagcacgccggacaagcagcgcacggtgatcgtcgtcaccgccagcgagcagatcgccaagcagttcgacaacatcatcgacctgcgctgaccttacaggccacgtttcccgttaagggctaggatttctcgttacgggctggggcaacatgcattacagaaatccccaactgttgaaaaatggcgatttgagattcacgctaccgtgcatccgtggtagtttgccctagcccgtaacggaaaatcctagcccgtaagcaatctgcaatctacaatctgcggatcagtcgaccaaacgcatgtgataatgctcggcgagcgccggcacgtccggttcgccgtatttgcgcaccagttcaagccaacgctgcttgttctccgcgccaaaccgcgctgccttgcgcgcgtaggcggaggcggtgaggaacttcggcggcaccgacttgctgtggtatttgtcggccaccatgaccacctcctgctcgagattcaccggcacgtagtcggccggcggcagcggcagatgctggtcgatcacatcttccctcgtgagtccgcagccggtgtgattgcgcgcgaattcggcgatcgattcgtcatacccctcgttgaggagcagttcatagccgatgagaccatgctccacataccgcgggccatcgaaactcagcggttcgccgttcgaaccgtcgttcttgagcacggcgtaggtgcctatgtcgtgcagcaaggcgccgatcgtggccttttccacgtcgatgtaccgtgggggcaccatgccgccggtcacgccgtcggtgggtggcacgacgaaccgatcttcctccggcgagccgatggcgtcggcaatgcgttcgccggcgagcgtggggtagtctcccgtgcgctcgagcgcgtcgtccggcagcgtgcagcggcgcatgaacagcgcgttctgccggtgaatcagctgccgcgtaatctgcgcgatgatctggcaatgcgtatggatgagatcgtaggcggcctgcgattgcgcgcatttgcgatgcagttcgtcaatctggccgaatgtaggaatgattccgctcatacccacactctagccccgatgccgcaaattggcatagtttgcgcacatgcgcgcctgcgtaaaaagggacagattggtgccgctaaatgtctccaattacgtcgtcgagacgtaaaaagagacagatttgcgcaggtaaatgtcccaaattacgcaggccgagagccagtcgaacgcagagcgagagcaggcgcgcggcagattgccgccggtatcctagcgctcacccaccaacgattcagatcgaacgcacgcggaaggcgcccgtgcggttcgaggcgacgatcatgcgattgttgccgaggtctttccagccttcgtccgccggctgcgcgaaaccgctgctcgcggcgacgacgcccttgcgcgcgccatccgcaccggtgatctcacggtacctcaccgtgcggtaatctgcggcctctgcggcacgcccgtactgcgcgtacacgtcgagcacatcctgctgtgtgggcccgttgtcgtgcgcctcgagcacgatgagctggtcgcggctctggattatgcagttgtagctggaatccgggtatgcgccccgcagttcgcgcaccgcctgagcgagcgcctcctcgagttcgtagccataaccgaggtactgcagcacaatggcgaagtagatcgcggaatccgaacgtccacccgtggactgcacgagcgtgtggtccaccgggtatgcgcggttcgtcgtgatgttgcgcccctgcgcatcactgatgtctccattgtgaatgaagctcagtccgctcgcgtagaacggctgctggttctccagcacgagcggcagattcgagctggccagtcgcagatgccagattccgccgcgcaccggcacgcttgccaagtcgccgaaaatcgagtcgtagcgcgcggcgattgtattgcggtagatcgccgagccggtggatggcgagggcgcgccgccatcggtcacatgggcagtctggtccggctccttcaccatggccgttccccaaccgtcgttgtgaatctcgctcagctcgcggaaggcgtcggtgctctgcgcacccagcacctcgcgcagcgagatgttctcgttcgcggtcgcgtatcccagtaatctgcacatggttgtcgagtgtagcgtgcgcatgttgcccattcacccattttctcgcaatcccgttatcgcatatttctataacgggcatctcatcgtcgggatttcaacgattttcacagattgtccccgcacacggcctgccgaaatcccgcaccgcaagatttaccccgagcaaaacgtccctcccgatttgcataaaaagctctttttacgcgaaagctcgctttacgtgaaaagagacagaaaaccgcgcgaacctgtcccaaattacgcaaacggacctacgcgcaaagggtcactgcacacaggtgcgcacagcctagttgatgcgcttcaggcgcggcgggcgcacggtggcaaggaacagcggctgcacctcggtcaccgggtcatacggggccaagccgaaccatttgatgggcgagccggcgacatggcggatcgcatacttgatgcgcagggccatcgcacccctttgcgacaccttcgactcgggcatgagctccttgtgaatgagcacgtagcgaatcgggccgatctccggatcggcatccaccttcgggtacgtgctcttctgcgcgggaagttcgccggtgcgcagcagatcgtgcataatctggtgcagatacgccggcaccgacgtgcgcaccttgaatcccagccgaatgcgcacgcggaacaggaagtccgtgccgagcgtctccaccgagtattcgcgcgtgaacggctcgtccgaggtctccaccgaaacgcaccaccaagcgtgcgcgcgcttcgggtggctcgcgaagatcgagaagaagatgtcggtgtcgatgcgcttcatctcggtgtcggaggtcaaatacacgatgttgtcggcatagtacggaatcgtgtcgtcgtcgtgcaggcgatgcagcaccggcaggcaatcctctgggctcatgtggcgacgttgcgcgcgctcgagcttcgtgccctcgtcccacgtggccatgacggtgaggatcgcgagcgcgagcagcatcgtgaaccagccgccgtgcaggaacttggccatcgacgcgatgaagaacatgaacatgatcatggggaacacgatcgcgaacagcaccgccgcgaatctgctgcgcatatgccacaggtacacggtgacgagaatcgacgtcatgatcatcgtgatcgtgagcgccaagccataggcggcggcgatgtgctcggaattgcggaagatgagcagcaccagcagcgtggagcagcacagcaccacgttcacggtgggaatgtacagctggccgcgcgtacgggccggatagcgcacctgcaggtggggcatccagttgaggcgggtggcttcggagactattgtgaatgcgccggagatgagcgcctgcgaggcgatgatgccggcgatcaccgacagcagcacggccacgtagcgcacgccgggcgtcagcatggcgaagaacgggttgggggcgttcccgtcgggtacgaacgccggattctcgagcgtgcggatgatccacgcgccctggccgaagtatgagagcacgagcgcaaggttgatgaacggccaggtggcgtagatgttgccgcggcccacatggcccatgtcggaatacagcgcctccgcgccggtgatcgacaggaacacggtgcccatgagcgccaggccggcgtggttgtcgccgctgacgaggaattggatgccatgcaccgggttcagcgcgcgcagcacctcgaggttctgcgacatgctgatcgcgccggtgaccgcgatgaacaggaaccagacgagcacggtggaaccgaacaccttgccgatgcgctcggtgccgcgcgactgcacggcgaacacggcgagaatgatcaccagcgcgatgaacagcgtcaggctcgggttctcctcgaacacgccctgcaatgcgggcagcgtctgcaggccttcgacggccgagctgatcgacatcgccggtgtgagcaccgaatccgcgaggaatgcggccccgccgatcatcgcgggaacgatgagccatttgccgtatttgcgcagcaacgagtacaacgcgaagatgccgccttcgcccttgttgtccacgcgcatgcagatgagcacgtattcgacggtcgtgatgagcgtcatcgtccagaacaccagagagagcatgcctatgaccgcggtctcgtcggcatgctgcacaccgccctgaccggcgaggaacgtctgcatcgtgtacagcggcgaggtgccgatgtctccgtacaccacgcccagcgccacgatcgacatggccagtgtcaccttgtcggggccggactgcagcgtccgccaccagcgacccaccggaccgaacgccttgtgctgctcgagcttggcggcctcctggcgtttcttttcgttcgcctcgatgatcgccaggcgctcttccttcgtgagcaccttatgcgacaccttcggtgcctgcgtatatttgtcggcggtgcgtaacagcggctcgtccgcttgctgctccggtctttcgtccatactcattccttataccatggcgcgccttggggcactccacactgtgaagaaacaacgcaaactgccacactaatcagcatcgagacaacaccctcggccaatccgccgaaggcagagtggtcaacggggaatgcattccctgcgcacggggcatgcctgcgggaccataaccgttgcgaaccggccccaatcgggcgcttccggctcagattccatacacctcgcgcgtggtgttgcgcgtggcccgtgcgacctgttcgaccggcgtgtcgagatattcggcaagcgcggcgagcgtgtacgggatcatcatcggcgcgttcggccgcccgcggtacggcattggcgtcaggtatggagcgtcggtctccaccatcacatggtcgagccccacaagtgccgcagattcaagaatgccggtgttgcccttgtagctcgacgctcccgacagcgaaagataccagccgtgctcgcgtgcgatctcgcccatctcggcatcgccggaataactgtggaacacggttttgcgcggggcgccgtctgcgagcagtgtctcgatgacatcgcggtgtgcgtcgcggtcgtggatctgcatgggaaggtcgagctccttggcgactgcgatatggtcgcggaaggcctcacgctgaatctccttggcgctctcgccggtgcggaacaagtccatgccggtttcgcctatcgccaccacctgtttcggatatgccttggcaagccggcgcacttcggtcatcgcctcgtcgaacggcacgtcgtgccatggtttgtagcgcactggcagaccgtcggggccgggtgccccgcgatgcccgtgcaacaccgcctcgttcgggtggatcgcaatcgccgcccacacgctgcccgggtgttcgcgtgccatgtcgatggcggtcatcaggtggggcagttcgcaaccgcagtcgatcacgccctccacgcccactgcggccgcctggtcgagcagttggtcgacgctgtagacggcgatctccggctgccctttctcgacggcctcatgactcaatgcctgtgaaaaaggcaccacggaggccacgtgcgtgtgattatcgatcacgtgggcgtcctgcggcaatgcgggcggcagtggcgcccaatcacgaaccctgtgcttcttgctcatgctcccactctaccgcccgccacctttgcctttgagaaatctgccggcaggttcgcggtgacccgcgctatttggggcgtatattttgagattcatataaacttctgatttagcgccccgtaattgagaagtttatttgcagattcatataaacttctcaattacgcagattatcgcccctcgatatcgtgcccggcgttctcgctggcatcgtcatccgctgtgccatcggcagatggctgcgggaatgtgatggcgaagacacgtgcggagggctccttgtctgcggaggcttcgatgcgcacggtctcggaatccgcccattcaatgcgccacggcttggcatcgggcgcatgctccggcttggccggattggggaacacctgctcgatatgggctccctcaccaatctccaaatacagcgaattaatgccgccacgacgccagatggtcaggtattgggcctcatcgacgtgctcggagccttggccgtcagtgccattccagtcttcgtcatgcgacagcccggtcacattgggggcatgccgcaaaccatacacgagccaagggctgttgaagtccggcaacccacagggccaccatggcaccagatgcgattgcccgcccaggatcgtgcggtgcagtgcgatcgcatcgcgcaccaggcccagccgcgcctcgtccatgcggtcgatgaaccccgagaggtacaggcggcccagaatgcctgcagccagcgtgaacacggcggtctcgtcgtccatctcctgctgtgcatagccccagttgccctgctgctccggaagcaccgtcatgccggcgccggcggcgatcgccgcatagacgagtggatcggactggtcggaggtggactgcatgtcgaggcggctcagcatcgcatagtcggccctcatggcaccggaaccgcagttttcgatcatcacgtcggggtgtttggcgcggatctgctcgatccactgctgcaccgcgcggcaatgctcgagcaggccctcgcccaccgaatccgtgtcgacatcggtgccggcacccggcgtcgtgttgtagtcgaacttgaagaacctcacattgaactcgtcgatcaggcggtccaccgtggccgtggcatgggcgcgcgccaccggcgagcggaagtcgagatggtagcggccctgatcggcgatgcggacgccatgccggcagaagaacgccgagtcgggcagcatcttcgccagcggcgagcgcacgccgatcacctccggctccagccacaggccggccttcatgccgtgtgactggatgtcgtggatgaggccggccaggcggatgtcgccgaagcggttcatggagggtttccattcacccaccatgtcccaccagccgccgtcctcgctgtcgtaccacccggcgtcgatgcagaacacgtcggcgcccaccttggccgcgccctccacaagcggcagctccttctcgatgcgggggtctccccacaacgtgttcatgtagtcgttgtagaccacgagacccttcgcctgttcggcctgctccagacgccccatctccatggccttcgcccggtagagcgcgcgccgctgcacggtcatctcggccacggcatgctgccagtcgcccgcgcagaccacgaacgagaccggcaccgtgacgaagggctggttgtcgcgcagcatgatgaaccactgatggtcgtcgtattccggcccgtatgcgctcacgcgcagacccgggtcgtcctcgccgatctcccattcccaggcgccgttgtgctcgatctgccatgcgaatgagaaatggccgagctcacccgggcggccgcctccttcgacgatgcccatcggctcgaattcgccggtggaccacgtcgaggtggaacggcgggcgaatcgggcggaggacatgcccggattgatcacctggttgcggtcgcgcagcgtggtggaacgcagcggggcgctttgccaggcgttctcgcagtcccacgagctttctccccaatagacctgcgcctgcgcatcctccagtttggccgcttccatgggcagtgttgcgttcatcgacgacaccgcctccactggatatggctcctcgctgcacaaccgtgtgtaggtgcgcacggcgctcgtgtgcgccgtggcctcgaacacgctcgtcaccaacgggccgtccccgtccgggtcgcgctgcacaatcgcgagcagcgtgaccggctgtcgctcatcgcccaatctgttgagctcatatgcccgcacgaacctcagtttgaggccggcggacgaaacggcgagcttcagtctgttgtccccgccgccgtcaagcgaactgcgcagttccacgatcggctgcgcatccggttcgccggcgatgttcgcatctaccggctccatgccccggccgctcatgccgatcaatgtcaccggtctgtcgtcgctcacggcgaagacgagcgtcaccgttccgttgccccatacgatgcgccctttcgaatccggcttcaaggcgttgcggggcgccgtcaactcgtccaacaatgcggggcggctatgttcaagcatcacgtattccttcctctgcgttgccgtctgactacgctagttcgccgatattgcgaacatgtgcacgcatacgtcggtcacatgccgaacaggtagtccacgaacagtcttgcgtaatccttgttctgcacgttcacgaacgagagctgggcatgcgggtcctgccccttgatgcgcgtccattccgccgacttgcccagatcgatcgccttcgccgcgccgccttcgccgtccgtcacgagtgcgccgcgctcgcgcagcttgcccatctggtaagacgtgagcacgttgtcaagcggctcgagataaccgagcagatgctgcgagcgcaatgccgagtcgtcgccgatgatcgtgttgatcgtgccgcccgacatctgcgtttcgagcgtgtcgagcgacatgcttgcagattccttgttcgacgagtcgatgtagagatcgttctcgaacgtgatcttcttctcgtcgagcgcgcggtatttgaggaagccgtcttcgagcttgtccatcgagcggtcggattcctccacgcccacgaaggcgacgccgaggccctgccccttcggcgagatgaccatgttcaccacgaacgcgacgatcgcggcgaacaccacgacggccacgatgatgggccagaagaaatgatggtagaagtacggccacttatggctcttcggcagttttctgtaggtcgcccatgcgctttcgtgctcggtgacgtcgggcttggtgagttcgctgatgtcctgctgcacgttcttcggcagcatatcgtctttgtcttgcatgattcctcctaataccagcgcggcacatgcggtcggcattccaagaccgctgtatgcggtgcgctccatattcgacccggaacgcgcatcatgtgcgtttccgcgttgattacctaatttcagcatgccattcggcacgattgcccgtcggccgccgcgtctattcctctcacagcaaacgcgccaaggagggtgtttcagtcgcctcccgagatcatcgcatactgcgattccacgagacgccaatattcgccgcgcttggccatgagctcctcgtgcgtgccgcgttcgacgatccggccgtggtcgacgacgcagatcatgtcggcgttctcgatcgtgctcaatcggtgcgcgatgatgaagctcgtgcgtccgacgagcatgtgctgcaacgcagcctgcagcgcctcctcggtgcgggtgtcgatgttgctcgtcgcctcgtcgagaatgaggatgcgcgggtcggcgagcagcacgcgcgcgaacgcgatgagctggcgctggcccatcgacagcgtggagccacgctcctgcaccaccgtgtcgtagccgtcgggcagttcctcaatgaactcgtgcgcgtgcacggccttggctgccgcgataatctgctcgtcggtcgcatcgagcttgccgtagcgtatgttctcgcgaatcgtgcccgagaaaatgaacgtgtcctgcagcatgacgcccatctgcgagcgcagcgaccgcagtgtgacatcgcgtacgtcgtggtcgtcgatcagcacggcgccgcccgccacgtcgtagaatctggagagcagattcacgatcgtcgtcttgccggcaccggtcgggccgacgagcgcgacggtctggccgggcttcgcatgcaggtccacatggtcgagaatgttcctgccgtcgggttcgtagcggaacacgacgtcgtcgaagcgcacgtcgccgcggatcggcggcaacggttcggcgttcgtcttgtcgacgatgtcgggctgcacgtcgagcgtttcgaagatgcgttcgagatacgcggagcaggtgatgagctggttgtagaagttgccgatgttgatcaccgggttccagaagttgttcgcatagccgacgaacgcgatcaatgtgccggtggtcgcggtgacgccggccacgtgcatgatgccgacgtaatagatcagcgccatcgtggacatcgagatgatctccatgctcggccacagcaggaactggatgtgcacggcgcgcatccacgcgcttcgctgctcgctttgcagatgctggaacgtctcgtactgcccgtgttcgcgggcgaaggtctgcgtggtcttcacaccggcgatcgactcgtgaatgaacgcgttcacgttgctctgcttgttcgacagattctggtatgccttgcgctggaaatgctgcagcacgcgcaccaccacgatgagtagcgggaacagcagcagactccacagcgcgagcttgaaatcaatcgcgaacatgacgaccagcgtgatcacgaaggtgaacacgtcggcaatcacgttgatcaggccggagctcaatgtgtcggacagcgtgttcacatagttgaccacgcggatcagaatcttgccgtgcgggcgtgaatcgaagtagctgaacggcagcgtctggatatgcgtgaacaaatcgcggcgcatgtccttcaagatcagctggcccacgcgggtgatctcgagcgtgcggtagcgcagcgcgacctcgtagagcacgctcagcacgagcatgaccacgacgagccatgccagcagcgtgtagttcctgtgcggcagcacgtcgtcgatgaccactttggtcaggtacggcacggccaccgtgatgcagctcatcgagatcacgacggccgctattctcgcgagccgcctgccatgagggcgcaggtatctgcctattctgcgcagatcatggaaattgatgctctcctcgagctcttcgtcttcgcggtacgtgttgcgctgtgccataccggctcgcctcctttcaggattacagattggtgtgcggattacagattgcgaattgttgattgctgacggcggatccgccgatccgcggtccacccaccggcaggatcattgccgcagattgtcggcctgttggccgagttgtttctcgtagatgtgctcgtagagcccgtgccgggcgatgagttcgtcgtgggtgccgcgttcggcgatgcgaccgtggtcgagcacgaggatcagatcgcagtccttgaccgacgagatgcggtgggcgatcgtcacaatcgtcttgcggtcgtcgaggtccttgagatgctgctggatctgcgcctccgtctccatatccaccgcactcgtcgtgtcatccatgatcaggatcgccggatcgtcggcaagcgcacgggccaagctcaggcgctgcttctggccgcccgaaaggcccacgccgcgttcgccaaccaccgtctggtagccttccggcatgcggcgaatgaagtcgtcggcaccggcgatctgcgccatacgccgtacgaaatcggagtcggtcgcctgttcgtcgctcgcgccgaagccgatgttgccttcgattgtgtcggagaacaggaacacgtcctgcgccacaatagccacctgggaacgcagctgcttgagcggccagcgtctcgcgtcgatgccatctatggtcacggtgcccgaggtcgggtcgtagaagcgtgcgatcaggttcacgagcgtcgatttgcctgcgccggtctcgccgagaatgccgagacgcgagccggcgggtgcatggaagtcgatgtcgtgcagaatcaacgtgtccgggtcgtcggggaacgcgaaatccacatggtcgaaacggatgtcgccgcgcatcgaatcgggaacggtgccctcacgcgcggccttcgtgttcttcacatgcggcgtggcggtgaggagtctgcgaatgttcacacagctcgcgttgaagcgctgccagtcgttgacgagccagccgaactggcgcaccgggccgtcgatcatccacaaatacgacgagaacgcgacgagtccgcccaggctcatcgcaccgcgcgccacaaggaatccaccgaagccgagcgtgatgagctggagcgcgaaaccgagccagtcaaggcggggcagatacttgcgcgtgttcatcgccatggccatgttgcgatccatatagtcgtcgttgtgctcgtcgaacttcccggtctcgtagtcctcgcgcacgaacgccttgaccacgcggttgccttcgatgttctcctccaccatcgagttcatcgaggcgagcgaattgcggatcgcaaggaacagcggcttggccttcgtggagaactggtgggtgaaaatgaacaggaacggcgtcacgcaggcgagcgcgagcgcgagacgccagtcgatcgacgtcatgaacgcgagcgcgcccacgaacatgacgacgcagttgagcatctggtagctcacccagctgagcagatggcggatcgcatcggtgtcggaggtcatgcggctcatgatgtcgccggtgcgcgtgtgattgaaataatcgaagtcgagcgtgtgcagcttctcgtattcgtcgctcaccaaccggtacacggtgttctgcccggcgcgttccatccacatctggttgccgtagtaggcgccgtcgcgcacgatcgtcacgccgatcagcgccaggcacaggccggtgagcagactgagctggcgctgctcgatcacgcggtccacaatgcgcgcggcgatgagcggcgtgaccaatgccatcgcggcgctgacgaggtacaggatctgcgcgccgatcacacggggcagctccggcctgcaatacggcatgagccagcacagattgctggcgttcctgttgcggttcgggtcaacgtacatcgagggcgtccttgctatgcgtctgtgcgtatgcatgtctgggcggcgccgatatgccggcgtccattgcccgtatgcatcgatgccatgcctgtggcgtatatgtgcgcgaatggcatacgggtatttctttgtttgcccgccttattattggcgcgttcaccgcgatatgcaaccggctgccgcttcggcgtgttatgcgatggagaggctgcctggatgcgaatggagtccgaaaaccctgcagaaagagagaagccggcgggattgaaaccgccggctaacagagagaagagagaaaagggttcagttataagggattccgagtggaacctcgtcggctttctttcgattgccgatggttattaccatgcccgtcgacccttaacgcatcgagtgttttcgctgagaattcgctgggtatgctcctatcggcacactgcagggcaggtgtagagcgcgcggagcagtgccgcccatctgccgcaggccttgcaaatacatggattccagccattggaacctcagccgccgcagcagtgcggcaattgctggcaaacaatctgccctcatgccgacttatctgccagcgaactctatgactgtcggatgcccgcgactgatagatcaacagcctcatcccgcaatccactttgcgtaaaaagggacaaatagaagatacagatgtccctttttacgcaaggagggctcgcacgatgatatttcagtcgatatttcagccaccttcttcctgcatatgttcctccacatgttcttctgcgtaaattgggacaaatacacactgccacctgtccctttttacgcgaggaaaaccaatttcacacaggaaggactcgcacgtgctccagtcatcgcatgtttccccgtgtaagaagggacaaatagacgtgtctatttgtcccttcttacacggactgcattacgcagattgtatgcgaatcagacgagtcactcctcgccggcagcgagcttggccttctcggcgtccaggcgcgcctgttcggcctcgcgacgtgccttgaggtcggcgtcgaaccgggcgagctcctcgtccacggcctccggcgggatcttcgcgaagatcggcgtcggcttgaccactggcgcacccacgacgatcggctcgctcttccacggatgcacgttctcgccaagcacatacttgccggtgatcaccgggtaggtgaactccggatcgtcgagatcgttcacctcctcgatgtgcggcagcggcgagaatgtaccctcgccacccagggcctcccacaccttctgcgaggaatgcggcaggaacggggcgagcaggtggttggcatcggagacggcttgggccgccacatgcagcacggtgccgaggcgctccgggtcgtccttgatcttccacggctcggtggccgagatgtatttgttgatgtcgcccaccaacgacatcgcgtcgttgagcgcgctcttctgtcgatgctgctcgatgagcgcgcccaccgtgtcgaaggctgcggaggactgcgccagcagggcacggtcctcatcggtcatcttttcctccacgatcggcgggatctggccgaagttcttggcgatcagattcgccacacggttcaccagattgccccacgaggcggcgagcacctcgttgttctggcgcacgaactcggcccacgtgaagtcggagtccgacgactccggacctgcggccgagatgtagtagcgcaccgcatccaccgggtaacgggagagaatgtctttgacatagatcacaatgccgcgcgacgacgagaacttcttgccctccatggtcatgaactcggaggccaccacctgctcgggcaggtcgagcctgccgagctcacccggctcgccgcccttggacccctcgccgttgtaggcgagcatctcggacggccagatctgcgaatggaacgtgatgttgtctttgcccatgaaatagtagcccggcgtggccgggtcgttccaccatgcgcgccaagcctccggatcaccggaacgacgcgcccattcaatcgatgcggacaggtagccgatcaccgcatcgaaccacacgtacaggcgtttgttcgggttgtcgatccaacccggcaccggcacggggatgccccagtcgatgtcgcgggtgatggcgcgcggcttgacctccttgaacaggccgatcgagaagttgagcacgttcgggcgccagcccttgcgcgtcttcagccatgcgaggttcgcctccgccagggcggggaggtcgaggaagtaatgctcagtctcctcgaagatgggcgtttcgccgttgatcttcgaaactgggttgatcagctcgtccggatcgagctcattgccgcagttgtcgcactggtcgccgcgcgcgccctgcgcatggcagatcgggcactcgccttcgatgtagcggtctggcagcgtacggccggtggacggcgagatcgcgaccttctgcgtgcccttgtaaatgtagccgttggccagacactggcggaacatctcctgcaccacgtgctcatggttctttgtggtggtgcgggtgaacagatcgtagctcaggccgaggttgcacagatcgttcgcgatcacgcggttgtagcggttcgcaagttcctgcggggtgacgccctccttgtcggcctccaccagaataggcgtaccatgctcgtcggtgccggacaccatgagcacatcgttgcccttcatgcgctggtatcttgcgtagacgtcggacggcacaccgaagccggcgacgtgaccaatatgacgggggccgttcgcatacggccaagcgacgttcaccataatatgactcatacgcccgattatcttcatgcgctaggacacttccgcactgttttccgccctgttgcggcatcaccatgcgcggactggcggagcctcgattattcacaatccacatcgcatgccttcacattatccacatatccacatttcccccgaaacagctggagcccaccccatgtccttcctagcatgtgcggtatgcgcatccgtgcgcatacgcagcgacctacaggcaagggagagagaagagaaaggaacatacgtccgtgaacaccaccgccgtacaggaagcggtccgagccggcaacgaggtcggctacatggtcccgctcgacctgggtcccgcctatgcggatccggaaccgcgcgtcccgcgccagccggaacgcccccacaactcacattcgatcatccacaccaaacagctgcccggcccccttgccatgcaacgactgctcagactcgacgcgttgtatgagctcgacgagttccacgcagtcaccgccgaatgcgcgcacacgttgtacgggcgcgccatgctgatgcgcgacatactgcccaatcgcaccacggcatgcgggcgcacagccgcgtgggtatgggtgggcggcaggctgccccaggattatttcgaagtgctctcatcgagccattaccgcagactcgcctttggacggcgcatcaaggcatggcagcggcaggtggatgaatcgcagatctccaccctcaacactctgaacctcacgacaccattgcgaacggcctgcgatctggccatgtacccgaaggacgacccgcatgcgcgcgacgtgcagtcgatcattggacggctcatggagcattacgagttctcgttggtcgactgtgagccgattctcgaggaatgctcgcatctgcgcaatctgccgcaggcccgcgagatgctgacgcaattcgaaagcatcgcctgaccgaggaaagcaatgaaagaaggaaaaagagattatggacgcactcccccacgcccgtgcacacaggccatgcatgccggctcgccgtgccggcatgccgctgcgagcggcacggcgcagacatgccgcatcgcgcacggcatcgcaagcgccgcgtcgacgcagcagtgcaaaacggttggcgagcacactgcacacggcacacacgccgaacaagggcctactgcatccgccaccgccgcccctcgcgctcacaccgcagtcggcaagcgatccgaacactccgatggacgcgttatggcacatcgctcgcacgatgccgccgttgcgcaaatgggtggtggtgaaccgcgcggcggacgcgaatctgctcgaatacatctcgcagcagggagggccgggagtcaggcaggcgttggaattggtactcgaatcgcttgaattgcaacgcagttccatgcagcgcatgcgaacgtcataggcccggcaatgccaacgggatgccggtcggcgaatcagtcgcgcaacgccagcacggcgttgtatacctgcttgcggttggcgagtgtgccatcggcattcgggtgtttgcctatcacctcggcaatggcgtccttgatgcgcatgccgtgcgcctgcgcatactgcatggccagttcggcgagctcctccacggagagcgactgtgcgggatccgcctcgtcttcagaagcgcccgcgatcacgagcaccatctcgccgcgcggcggatcgttggcaaccgactcgttgatctcatggatggtgccgcggcgaatctgctcgtagtccttcgtcaactctcggcacaacgccatgcggcggtccgggccgaaaacctcctcgagatctgccatcgattcggcaatgcggtgcagcgtctcgtagaacacgatcgtgcggcgctcgcccttcaacgcgcgcaatgcctgcatgcgttcggaatgcttgcgcggcaggaatccctcgtagcagaaacggtcggtgggcagcccggagagggcgagcgcatcgagcaccgcggaggggcccggagcgcaggtcaccggcaggccgcgttcgatggcgcggcgcacaatggcgagccccggatcgttgatcgtgggcatgccagcgtcggagacgacgagcacggtctcgccattcgccacatggtcgagcagtgcgtcggccttgccgcgttcattgtggtcgtggttggccaccacgcggccgcccacatgcacgctgagccggttggcgagcgcatacaatctgcgggtatcctccgcggccacgatgtccgcgcgctcgagcagcgcaacgagtcgggcggaggcatcggcagtgttgccgatcggtgtggcggcgagcaccacggttccacgtggaacatctacgtggagagtgcgcgtctcgtcagcgggatcctcggcgatgccggtgtgttcagactgctcgttcatacgttcagtatgccgcgcgggcaggtcagcgggaggcgaaacacggtgcgatggaggcgatgcaggagcgtacgtcggcgcgaacccacgcgggcgtgtaccgtggaaccgggtatgtgcgcgcggccggcgcgcatgcgaaatgtaaggagaacagatgggcatgcgttccacaggcacccccaaacatgcggcggcagagcgcgtcgagctcgaatcatccgaactcgcggcatcatcgccgcccagcgcccatgcgcgtctcatgacgtgggtgtggacgctggtcatcgcgttgttcggcggactgctgcgcttcgtgaggctcgggcagccgcgcgcggtcgtcttcgacgagacatactacgtgaaggacgcctggaccatgctcaacacgggcgaaccgatgagctggcccgacgaggtgagtctgggcggccagatggtgccggtcgacaccgcgttcgcagacggcgacacgaatgcatggatcaacaccgcggaatacgcggtgcacccgccgctcggcaaatggcttatcgcagccgggctcaagctgttcggcggcgcggcgaacccggcggcatggcgtgcggcgacggcgatcgcaggtgtgctcggcattgtgctgctcatccgcatcacactgcggctgttccgcaatctgccggtcgccctgctcgccggcctcctcatggccatcgacggcgtgtccattgtgatgagccgcaccggcctgcttgacatcttcatcatggtgttcgcgctcggtgcgttctcgctgctgctcatccaccgcgactgggcggcggccagactacgcatggcggcgcagtccggtgcgaacagacctccgcagatcacgttctcctggtggcgagcaggtgcggctgtactgctcggctgcgcgacgggagtgaagtggtctgggatctatttcttcgccgtgttctgcgtgatcagcgtgttctgggacgcctggatgattcgccaggccggcttccgctcccctcgtcaatggcttgcgcgcggcgtgttcggcgacggcctgctcgcggcgctctacatggtgccgctgtatgccgccacatacttgctcacctgggtcggctggttcgtgcacccgaactcctacatgcgtaattgggcggccacccataccggccagggcgtgcaatggctgccggccgactggcgctcgttcgtcgcatatcatgccgagatgtggcgcttccacaccacgctcgatgctccgcacgactacaaggcgaacccgctcacctggccgctgcagattcgcccgacgagcttctactggcagaagctggacggccacccgggcctgtgctcgctctcgccgcgctcgcagtgcgtggcggcggtgacctcgctcggcaatccgctcatctggtggctggggtcgctgtgcgcagtgctcgccattgtcatcgcgattctcaaacgcggcgattggcgcatctgggcggtgctcgccgggttcctcggcggctggctgccgtgggcccagtacctgaaccgcaccacgttcacgttctattcgatcgtgctgctgccatggatgattctcgccatctgctacgtgttcaactgggtgcgcgagacgagttcgcgcgaggtgtggctcatcactctgtgggtcatggtgggggtgtgcgccatcgtcagcgtgttcttctacccaatctggacggccatgcccgtgccatatgagttctggcgcatgcatatgtggctgcccagctggatctaacacgtcgccccacattcatcgccgcccatggcagacgacaaaatgcggcgcacttttcgtcatctaccaacgcaaatgccggcggtgcgcaaaattgcctagtctgcagttgcggtctcagatcggcacaccggcagcatgcagaattgtctagttcgcatctccagtctcagattagcaatctgcagattcctagattgctcaagcgagactggagttgcacgcgagacatgttgacggagcacaagattgcgcagcctgcgacttcagtctcagatcggcacactggcagcatgcaggatcgcccagtttgcaatcgcaatctcagattggctactctgcaggttcctcaacgcctgggtgagaccggagttacaaacaaagcgctccggcaaacgacgaaagtggcatctgagttccgtcgtttgccatgggcgatatcgccggcgacaaaccacaacaccgtcaaccggcgcctctattgtatgttcgttgaacaaacaaggcgcgggctcttccccgcccattcccgctcaacgaaagaggtgtcatgcagtattttgagaccaccatcatcggcatcgacggttccggagcgcgttttgcaggctatcttcccgaaaactaccccgacatcgtgcccgaccgcaagcgtccgaccgtgcttgtgctgcccggcggcggttatgagatgaccacaggccgcgagggcgagccgattgcgctgcagttcctcgccgccgactacaacgcgtttgtgctccactattcctgcaaaccgtccgtctaccccattgccgtgctcgaggtggccgaagccatgcggcagattcgcgcgcacgcagacgaatggaacgtggacaccgcgcgcatcgccgtcatcggcttctccgcgggcggtcatctggccgcggatttcgccacttccgccagcgatgccgcgctcgtcgcgcacggctatgatccggacgaactgcggccgaacgcgctgatgctctcctacccggtcatcacatcggggcgtttccgtcacgacggcagcttccgcgcgctcctcggcgagcggtacggcgaggagtcggcgatgaatgaagtgagcatcgagcagcatatcgacgcgaagacgccaccggtgttcgtctggcacacgatgcccgacgattgcgtgccggtggagaacacgctgcagctcatcgccgcatgcaaggcggccaacgtgccgattgaggcgcatctgtaccccgcaggtggccacggactctcgctcggcaccgcgcagaccgcgtggggcggcgtcaacagcatcgaacccgccgtgcagtcgtggatcttcctcgccaaggactggctcgaccgcaccttcgctgaatagcacacccacccgccacccatgtcccagattacgcaaacgaaccccactcgtcagcacctatctatctgcgtaaaaagggacaaatagccgccataaacgtccccaattacgcaaaatcctgtcctgcgtaaaaagagacagattccagacgcaaacgtctccaattacgcaaccgagcggatggcatcgccgtcacctccaccttcccagctctcgacccacgcacctcctcattggcatggttgcctacctgtgctatgaataatcaaggagattgagaagcacacaccgctcgacctatcgaagaggacattcaatccatgggattcatccaattcattgccaatctgctcaaagacccgcgtgcggcgatcgccggctggatcgcaatgggcgtggcgccaacacttggctttgtttttctaatcgtcttcattgagaccggcgtggtcttcttcccgttcctgcccggcgactcgttgttgttcgccgccggtttcttcgcggcgcccgacgcggcgaccggcaaatccgcactgccgctcgccgccttgctgccggtggtatggctcgcccccattctaggcgaccaatgcaactacttcatcggccacttcttcggccggcgcatcattgaatccggcaaggtcaaggcgatgacccccgaacgtctggccaaaaccgagaagatgatcgaccgctggggcccgctcgccgtgttcctcggccgcttcttcccgttcatcaggacgttcatgccgttcatctcgggcatctcgggcatgcgttggagcagattcacgccgttctcggtgctcggcggtctcgtctggtcgtcgctgttcacgctgctcggctatttcttcggcggcattccggtggtgcaagacaacttcgaactcgtgatcgtcgcgattctcgtcatctcgctcatccccactttcgtcggcctcatcaaggcgaagaccggcaagaaggaagcgccggcacacgcgatggccgaggtcgccgagaaagaggcgacgcctctcgtagaggatctcgacggcaacatcgagcacggtgcttgattccgcacagcatggccaacgaagaacgccaaaagaggctccgcactggcccaaagcattcgcaaggcaactgcgaggcactatccgaaacccgcacgcatggaggaatttgcatttgggaaggggttgggctaaactggacgagttgtcggaagacgacataattgaagattggggctgtagctcagttggtagagcgcttcgttcgcatcgaagaggtcgtggtttcgattaccatcagctccactaaggccgctgcattcattccaccgcagcggcctttttctttacgtataagcacacaaccgcgctccctcactcagacgccatgcgcacaggatgccggatcaccgtgcgcagacggtcgggagcgcaccgctgtggattgctcaggtagatctcgtgatggtggcgcgcatcgctgaaatccagcgcatacccatgctcacccacaaacttgtcgagggcggcgattgtcgcaggctcggtgtcatacggcccgacgtgcatcacctgcgcacacaatccctcgtcatattcgaatagccgcgcgcgtgacacgtccgcctcggggtgcttgttcgcgaatagtccgcgcgcatgttcgaacgcgtccgctgtgacgaattcaggcaagcggatcatcgaaatccattggaaatcctgtttgcgcgcgtaatcgaccggctcactcgcgttccgccccatccaccacagaccttccagcggcggcacgacatatggcatgtacccggcgatgtgatcacgtgaatccttggatttctcgctcatcttgattgtgaacgatataccgtacagcagctgcagcgcgctctggtattcgccgtgcggatcgttcgggtcacccgccccgcgcaccgccacgaactgcatcgccggcacctcgacgattgcgggcgtcttgcccggcacatacaggttcttctgttctcgcttcacatcgtacggcatgagcacactgtagcagaaaatacatgaatgagccgcccgtatcagcatcatctctgagagagggctgatgcgggcatggaaacgcactcattccaccacggtgaacgtcgcttgccgcagattctcgtcgcggctcgaatgccccacgagcaccttgaattcgccgggttcgacgatccgctccgcatcgccgttcacaatcgtgcacgaatcgaccggcagatcgaaggcaacgcgccgcgtctcccccggctcgagcgtcacacgccggaacagcttgagctccttgcacgcccaggtgaacgatgtgacgacgtcgctgatgtacagctgcacgacctccgttcctgtgcgcgcgccggtgttcgtcagatccacctcgacgcgcaccgtgtcacctgcgcggaattcggaaccgttcacaatctgcggatctccgtattcgaatgtcgtgtacgagaggccctcgccgaacgcgaacgccggatcctgggtcagatccgcgtaccgattgccgtgctgaccgcgaatctcgttgtagaacaccggcagctgcccggcatggcgagggaatgtgatcggcagacgcccactcggctcggtcttgccgaagatgatctcggcaatcgcacggccgccctgcatacccggattcgccgcccacagcagcgcgccgagaccgtccgccgcggattcgtcgacaatcacgccgttctcgccgatcacacacgccggcagcacctgcggtttcgaactgacgagcacgacgatgagcggcttatgtgtttcacgtgcaacgttggcgagctcctccagcagacggttctggccgccctgcagttcgagcgtcgccgtcgagcacgtctcgccgacgagctgcacaacgtcgccgaccactgcgatcaccgcgtccgccgcgcgcgcctgttccaccgcctcgtcgagcagtcgctggtcgattttcgcggccaccgccatcttcggccgcggctgcccatccgggtagagctcgccttccgggtccggcaccagatccaccacgttcgcgccgcgggcatacgtaatctcgcaatctgcaggcgccagctcgcgcacgccgtcgagcaccgtgcagatcatctcgcgcggctggccttccggcatccacggcacctgacccgagttgcccgcccaatcgccgagctgattctgcgcatcgtccgcgagcggccccaccactgcgatcctgtgcagctcaccggcatctgcgaacggcagcacagcgttgttgcgcagcagcacaatcgattcacgcgccatctccagattgcgccgcgcatggtctgcggacccaatcaccgcgtcgatgcgcgcgcgatcgggcaaacgtggatcttcgaacagaccgagctggaacttgagcgtgagcaggcgcgccacggcgtcgtccagcagacgctcgtcgagcagaccttcgcttaccgccgcgatggcaccctcatagaagcccggggtcgtcatgatcaagtcattgccggccttgacggcatcggccgccgccactgtgtagttcggcttgatgtgctgctcccacacggcacggcccacattgtcccaatcggtcaccaacgtgccgccatactgccattcgccgcgcagcttgcggttcagcagccaattgttgaacgtgaccggcgtgccatcgattgactcgtagccgagcatgaacgtggcgcagccctccttggccacacgctcgaatggcggcagataccagctttccaacgcgcgatgcgtcagatcggcctcggaggcgtcacggccaccctgcgtgtacgaatagccagcgaaatgcttggcgcaggcgagaatcgcatcgtcggcgaaggtctcgcccgcggcagcgttcttctggtagcccttgaccatggcggatgccatctcaccaatcaacaccggatcctcgccaaaggtctcgtccacacgcccccaccgggtgtcgcgcgcaatgcagagcaccggcgagaacgtccaatgcacgccggtgcaggagacctcctcggcggtcacgcgggcggcatcctcgattgcctgcggatcccagctgcatgccatgccgagctgcgacgggaagatcgtggcgcccggccagaacgaatatccgtgaatgcagtcatcgccgacgagcagcggaatacccagacgcgtctggtcgcgtactatccgcgccgcacgcacgagatcgtcgggagaggtgtgcagaatcgaccccacatggcggtccacaatgagatcggagagctcgccactgcgcgcgtcgagctgcatcatctgccccaccttctcctcgagagtcatgcggccgagtaggtcggcgacgcgcgctggaatcggcagggacgaatccagatatggcgtatttgtttcacgtgaagtcataacaatttcctcatcgaaattcgcggaagacgcatatcccagcatataccgtaccgtcgagtaaccacccgcgcaaaccgacgaaagctccatattcgtcacgctgcacaacacagcgacagtcacagaatcgcgtcgcgttcctcgtcgttcaagtcaagcgcgccggcgagcatcagtttgatcgcccgttcggtctcctccgccaatccaatcgcatccgggtcgagcatccattgaatctgcaagccatccatcactgcgagaatcgacatcgccgtgttgcagatcgtggcgtcgtcaaccgatttgccgagttcgtcggccatgatgcgcagcgccttctcaagcatgcgccgcagattgcggtaccgcgagacgaagtagtcgtacgccgggctgtcttcgcgaatggagtccgcacagaacgcaatgaacgccttgaccaggcccgggcgcgcctcgttcgccttcgccgtcttgatgagatggcggaacgtgatggcgccatcctcgggcatgcctccgcgcgccatatcttccgggtaatcctcgagatccaccgaatcgcggtagatcaccgtctgcagcaacagattgtctttggagccaaagtgatgcagcacgccggcgcgggtcatgcccactttctcggcgatgtcttccaacgtgcccttcgtggcacccttctcaccgaacacctcggtcgcggcacgcagaatcaccttgcgtttctcttgcgtttccggtcgttcagccatgttcctccaccatttccgcgcgtcgcacatacgagggaccccgccgcacagacgaagcctctcccagtctaggtggggcgacgaccaattccagcaatctccatcaatgccggcattccgccaagccaccctataaagattcccaagagccgcatatggtcgttgagtgagcaacgcgtcacctcaacgaccataatctccccaagtacggtcgtttaccgcacacacgcgtcaccgaacgaccatattgcccgctcagcgcgcggccaattccgcaatccgacgttccaccacggcattcagcgactccggtgtcacgccgtcgtacccgtcaatcgacatgtactgcggaccgtccgaattgtcggtgcgaatgaagccgagttgcgcaatcgtcgtcgcaccggaagcggcggcggaggtgagtccgctcatcgagtcctcgaacgccacgcactgcggcatatcggcacgcggtatgtcgagtctgcgcgccgcctccacatacggtgccggatccggcttcttggccacgtcgtcctcgccgcacacatatccggcgaacgtgcctgcgggagcctgcgcaatgagattctcggcgagattgcgcggcgatgtcgtcacgagcacgctcggcacacccgcgtcgcgcagtgcgacgagcagctcgcgcgtgcccgggatccaggggatccgctcatattccgcccgcgtcacgtattcgatcatgcgccggccgatctcctccaccggcagcgtgcacccgtgctccgcgatctcgcgcgccacatccggcaccgggcggcccgagccgttccatgcgagctcgtcgttccacacaccgccgttctcgtgcgcgatctgcatctcgccggcatgccagtacggctcggagtcgatgagcgtgccatccatgtcccagaacaccgccttgagcatcattcgcctctccttattcgcagatttcctcgtccggcccagcatagcctaggcgcataacgcaaaaagcggccagatgaaaaacatctggccgccaaggattgctgtcagtgcttggccgtatgccacaacaccatcgatttcgactgcgcgcttgagctctcccccgccggcaatgcgtgcacctcggcatggagctgcccacgccaatagcgtgcgcgatgcgaacgcgacgtctgggtgatgctgccgttcatgtcggcggtgaacacgctgaatccggtcacaccggtgagttcctgcacttcatgccgcagttgccggttctcctcctcaagttcgaggatgcgcatcactccgttcagattgatgccttcgtcctgactgaggtgttgcgcctgcacgagccggtcgacgtcccgcagacagtaccgtcgcgaaccgccttccgtgcgccccggcaccacgagcccctgccggtcgtattgacgcagggtctgggggtgaatctcggcgatctgaccgaccttgcccaccgagaagacgggcaggtcgatgtcgaatcccacaccggccgcaccttccagattggcccgcttggccacgatggccgtcgcgcacatttcatacagcctgcgccgtgctggtgatatgcgcgtcattgtgatcacttcgtttcggtgttctctgtggcgagctcctcaacgaagtcgccgcacgccttgtcgaattccttcgcagcgtgcttctcgcccatggtcgggtgcttcggcacgcgaatctgaatgcgtccgacgaggtcgccggtgccggtgcgcgtctccacgcccttgccgcgcacgcgcacttcctcgccgctcgaggtgcccttctccaccttgaacgtgacgtcattgccgtcgaagtccctggcggagatcttcgcaccgtcgaccgcctggcccacggtgatcggcagatccatcacgagatccttgccgtccatcgtgaacttcgggtcttcggtcacggtgaccgtcaggtacatgtcgcccggcttgccgccgtgctggcctggcttgcccttgccggcgatcttgatcttctggccgttcttcacgccggcgggaaccttcgttttgaacttcttgcccgcggccttgagcgagaccgtggcgcccttgacggcctggcggaacgtgagcgtgatcttcgagctgaggtcgtcgccatcctcgggatgcggggcgggacggtagcctgcgtaggctccatcgctatagtccccgtagccgcggcctcctccaaagccgccgttgccggctccgccaccgaacatcgagaagatgtcgtcgaaccctgcgccatgggagccgccgccattcgtgctgaagcggatatgcgaaccgccgttgccaccgccaccgccgaacatggagccgaagatgtcggagaagtcgccggcgttgaatccgccgccgccggcaccgccagtgaagcgtgcgccacctgcgccgaaggagcggattgcgtcgtatttctggcgcgaatccttgtctttgagcacgtcgtaggcctcggagatgtccttgaacttctcctcgccttccttcgtcttgttgatgtccggatggtacttgcgggcgagtttgcggtacgccttcgtgatctctttctcgtcggcgtccttggagacacccaaggtcttatagaaatccttgttcagccaatcattctcagccatgctgctgtgcctcctttcgaggctaaagtctgggttgtattcgtcaaaaagtctgtatggaaatacccatgcatgaaaaacggccgtgaaccgtaaatcgaatgcggttcacggccatctcgcacgggcgtcagttctgcggagatgcgaccaccacgcgtgccgcgcgaatcacacggtcgccgatgcggtagccggcctcgaccacggtgtccaccgtcgccttgctggcctccggatccggcttgtgcaggatcgcctcatgcttggtggggtcgaagtcctcgcctttcaggccgaacttctcaacgccgaacttctcgaaggtcttgtcgatcttcgcggccacggccttgaaggaatcgtccatctcaccatgctcgcgaatgcggtcgatgtcgtcgagcccggggagcattgcggtgagcacatcgatgatgccctgctgacgggcacgatccatgtccttcttcgtgcggttgcggtagttgatgaactccgcgcgctcacgctgaagcgcctcgaggtattcggcggcttccttcttggcctggccaagcggtgtgagcgaggaaccctcagcgtcgccatcggaggcggcgtctgcggtggcttcggcagctgccttggcggactcttcggaggcctgttcgcctgcggattgctccgcggcggcatccttgagcatgtcgtctttcagctgctcgccggtgtccgatggcgcatcggcgccatcggcatcaggggacgcctgcccgttcgccagttcgtcggcgtcgggcaggtcgttcaggtaatcgtccttattgaagtcggacattacttgttgtccttgtcgtcgtcatccacgacctcggcgtcgaccacgtcatcgtcgccaccgttgttcgcggagccgctgtcggcggcgcctgcagcgccttcggcaccctgctgggcgtagagggcctgaccgatcttctgagcctcggtcatcagcttctcctgggcggccttgatcttctcaatgtcgtcgcccttcaaggcatccttgagctcgttaatcgcgtcggtgacggacttcgcgacgtcatcggagagcttgtccttgttgtcgttgacgagcttctcggtctggtatgcgaagttctcggcgttgttgcgggtctcggcgtcttccttacgcttcttgtcgtccgcttcgtgggcctcggcgtccttgatcatctggtcgatctcttccttcggcagtgcggagccaccggtgatcgtcatcgactgctccttgcccgtgcccttgtcctttgcggagacgtgcacgatgccgttggcgtcgatgtcgaaggtgacctcgatctgcgggacgccacgaggagccggagcgatgccggtcagctcgaaggtgcccagcggcttgttgtcgcgggcgaattcacgctcgccctgatagacctgaatcagtacggacggctggttgtcttcggcggtggagaagatctcggaacgcttcgccgggattgcggtgttgcgctcgatgagcttcgtcatgatgccgcccttggtctcgataccgagggacagcggcgtcacgtcgatgagcagcacgtccttgcggtcgcccttgatgacgccggactgcacggcagcgccgatggccaccacttcgtccgggttcacggactggttggcttccttgccgccgtcgagctccttcacgagctccttcacggcaggcatacgagtggagccgccgaccagaatcacatggtcgatctgggagaccgagatgccggcgtctgcaagcacgttgttgaacggcgtgcggcagcggtcgagcagatccttggtcatttcctcgaagtgggcgcgggtgagcgtctcgtcgaggtgcaccggggtcccgtcaggggtcatggccaggtactgcatgttgatcgtggtggacatcgaggaggaaagctccttcttcgcctgctcggcagcttccttcagacgctgcagggcgatcttgtccttgctcaggtcaacaccgtacttgttcttcacttcgccgacgagccagtcgataatgcgctggtcccaatcgtcgccaccgaggtggttgtcgcccgacgtagcctgcacctggatggtggagaagccgtcgtcgtccttgccgatctccagcagggagacatcgaaggtgccgccgccgagatcgaagaccagaatgcgctcgtcttccttgctcttctccagaccgtaggccagagctgcagcggtcggttcgttgatgatgcgcaggacgttcaggcctgcgattgtgccggcgtccttggtcgcctggcgctgtgcatcgttgaagtatgcagggcaggtgatcacggcgtccgtgaccggctcgcccaggtaagcttcggcgtcgcgcttcagcttcatgaggatctgtgcggaaatctcctgcggagtccattccttgccgtcgatgtcaacggtccagtcggtgcccatgtggcgcttgacggagctgatcgtgcgatcgacgttggtcacagcctgacgctttgcaacctcgccgacgagaatctcgccggacttgctgaatgccaccacagacggtgtggtgcgtgcaccttcagcgttcacgatgacggtcggttcaccgccctcgagcgttgcgatgcaggaattggtggtacccaaatcaataccaactgcgcgtcccatactgtatctccttttgttattcactattcgtgttacgttccgtgctcaagcccgtcgagccggccgctgttgggcgacctctcttgaggctttctaaaacttgagcctacatcactcaagtatttcattccatcctttattcccattgcagaacaaaaaaacccacatttttccagacgccctgaaatccgcggatttccaacgctttccagattccaaaaagagatatttcagcaaacgcccagattgcagtgggtgacttccgcaacaagcggcgtccaagaatctgcatgactcgttttgcatctccatctcaacagggcgttccaaatctcaccaagcgcaccttcatgagaccggagtcgcagattcggcacgattacgcgctcccccgatgaccttgcttgcaatctcaatctcgtcgaaacacggtagatacgccgagaaggtctttttgagaccgagattgcaagcgtagcacatctgcgcgctcctcgatgaccccgcttgcatccctgacctcggcagagcacggcatcgcacactcaataaccaatctgagactgtctttgcaaagcaagcatgctaagacgcgcctcccatgccccgctgagacaggacttgcaaacatggcaatctcacaagtcttcagataacctttcctgcaactccggtctcggcaaagcaccacaaaatgctccgcaatcgccagtctgagactgcaattgcaaaagcggcacacaaatccgcgctcactccccctcgtaccgcgaatccgaaccgcgcagcacgagcttcggctccagaatcgcatgcggctgctccagagcgcggccctccagcagcgtcagcgccttcatcgccgcattgcgccccatctcgtacgggttctgccgcatcgtcgtcagctccactgtgtcggcatacggggcgtcgtcgaatccgatgatcgaatagtcgcgcggcgccctgtagccgtgcctagccagcttgatcatgagcggaatcgccatcatgtccatctggcagcagattgcatcggggaaccggtcctcgctcagcaccgcggtgagcgcattgtcggcgaaatcgcggccgcgcggcaccgtgagcaccttccagctgatgtcgtgcgtgttctgtgcacgctcacatgcgcgtatgaagccgtgcccacgcaggtctatcgacgcgtcgagtgtctcggccgccgccgagcaggtgtagacaatccgcttatgcccgagtttgatcatatgctgagccgcccggtacatgccgccttcgtcgtcgatggtctcggaggcgtcgaaacggagcgggtcgggcgtgttgatgccgacgatcggcaccttcgtacggcgcaactgctcgatctccgccggctctatcgcgaacgatgccacgaacacggcgtccacgttgcgaagcacaggcagcacggtgaagaaccggtcgcgcgtctcggcgtcgttgatgtgctggtagagcgagatgtcatagcctttgccatgcatcacatcgtctatgccggcgaacacctcggcattgaaccagctcgtgatgccctcgctcatgagcagcgctacgcggtatgtctgcccggatttgagcgccatcgccgagcgtgagatgttgaagtcaagcttgtttgcagcagccatcaccctgtcgcgggtggcttgcgagacgagctgcggcttggtgaatgcgcgcgagacggtggagatggaaacgcccgcctcccgtgccacgtcacgaattccagccttgtgcatttcgtactccttatatggctgccgcagctttgcggcagattaattcgccattccgatcgccgcgcagagcacgagcatgatcgggtagaccgggtagaacgcccaacgcgtccaccggtgtgtatagccgagcttgtcgttgcggtagtggagcgccaccgcgcccaagccaggcgtcaatacgcaggccgctccgaatatggctgccgtgaacaccatcgtgttctcacgggaatgcaggtagtagtaggtcacgcacatgccgagcgtcacaatgcctacgttcatgagtcgctgcgtctggccgatcgacagcatgaaatcccacagcaggccgatgatgatcacacctgccgaaagcaccaccttgagcacactcgtgcgccatgcgtacatgaggtcgagtatgccgagcacgatcagcgcgaccacgaggccgaacacggggttctgcgagcgcatgtcgaacgcgctgccgaacaccacgtagtcgtacggcacctcgcacaccagcgcgagcacgagcaggcgcagcccgtagagccatgcgttgcccgtccattcgaatccctggtagagcagccacgcgaacatcgggatcgacgcccatgagatcgcctcgccgatcacgcagacggagagcgcgaacatgttctcgcggctcggcgtgcccacgatgtgcgggagcacggccaccgagaacggggagaagaacagcagcacatcggcaagcaccttcatgcggaactgcgagagccctttgcccttcacctctttgttgcgctccaagtggcgcgtgtattcgtctaccatgccggttcccgtctgttatctgagcttctcttccagagtatccgaatattcgcgcccacgcccgtcttccgtgttggcgcgttgtatgtaggcgagcacgcccgcgtaatcggcgccttcgagcgagcagactgcggtgtcgcactgcgccggcgtgtgattgtcggtatgcaggtagatgccgtcgatgttggccatgcgcgcgccgtcgatgtcgttgcgcggatcgttgcccaccatcaccacatgtttgggctccacgttcatgcgcacgagcgcgctgcggaacagttcggcggacggtttgcgcacgccttcgtcgctggagatgaccacttcgtcgaacacgtcgccgagtccggtcagctcgagttccggccgcgtgtagcaggcctgcgcgttcgaaacgagcgccactcgaagtcctgccgcacgcagctgcgtgagcatgtcgaagacgcctgggtacaggcggaacttcgtcgtggcggcgcggcggaatgcccacgccgcctttcgcgcgtgcaccagactgtcgtcggcccagcatgcctcgagcagaccgcggtaggcgggcaggaagtccggctcgaaccactccgtgcgcgcacgcgtcgcgttggcgcgcaccacctgacggcggaattcgttgcgcagttgcgaattcgtggcgtagtcggcgccgttttggtacagcgccgcccgcaatgcggaccacgcggcgtcggaatcctcctcggtgtgtatgtcgatcagcgtgccgtacaggtcgaagaacacggttgtgtagtgcgtcatgccgcctccgtcagcgttcacgtttccatatgctcagtgtgcgagcgggcatcgggaatcctccgccggcgatccgtatgcccgtctgccggaattctccggtcgacgtgccgctcgaatcgagcacgcacacccaccgcgcttccgcatggctcgcagattccggcgttgcgggcagatcgtcatgcagactgtcggcaaacgcggaatcgatgcgctcgacgggcagactgtactcctcgtcgtccggattgacgagcacggcgatgtcgtcgctacggtaggcgaccgcgttgcccggcgcctccacggcgatgtgctcggcgtcgaacaggcccggattcgcgcgacgcacggcgatcagacggcggtagtagtccacgaggccctgcatgcgttcggcgcgcgcccaatcgagttcgttcaccttgacgcccgagtcgaacgagttgtcgttgccgaacttcgtcttgccgaattcctctccggcgagcatgaacgggatgcctgcggccgtgtagatgagtccggcggcgagcgcgttcgcctcgagcaccttgcgcgtctgcgtgcccggcatcgcgcggtaggcgtgttcgagcgcgtcgtcgcgagattccagcgttctgtgcgagtcatcggcatgcccggattccgccttattcgcagattccggcgagtcgtcgccgatcatgctcaggcacagcttgtcccacagcgtccagtcgtcgtgggcagagacgtactggatgatctgcccggcgttgccttcgttggtctcgggcgcgcgccatgcgtccacggcgagctcgatctgcggcttggtgtcgtgcgcgttgccgttcacatagcctttgatccggcgttcgaacacatggcccttgatcgcgtcgcgcgttcggtcgcagaaatggccgatgcgcgagtcgagcagatgcaggccctccttgttcgcaagctcggtgccgggcagcgtggagctcggcccggcggcccacggttcgccgtacatgatgaggtccttgccgccgggcaatgcgtcgagcgaggcgcgcacggcgttcatcgtatcggtgtctatgagccccatgaggtcgaagcggaagccgtcgatgtggtattcgcgcgcccagtaggtgacggagtccacgatgtagcggcgcatcatcgcgcgttcgctggccatgtcgtcgccgcaaccggaaccgttcgacaacgtgccgtcggcattgcgtcggacgaaatagccggacaccacgcgctcgaaccagttgtcggccgtgtacatgtggttgtacacgacgtccatgatcaccttgaagccttgagcgtgcagcgattggatcatctgcttgcactcggtgatgcgcacggtgccgtcgaacggattcgtcgagtaggagccttcggggacgttgtagttaagcggatcgtagccccagttgtactgcctcgggtcgttctcgtccacggagccgtagtcgtagaacggcagcagctggatcgcggtgacgccgagctgtttgaagtagtcgacgcccgtggggaactcccctttgccgtccacggtggtgccgaggtcggtgaaggccaggtatttgccacggtgctcgagcgggaaaccgccatgcgggttcgcgctgaagctggccacatgcatctcggccaccatcgtctcgcgcagcggggtgatcgggtgcgtgtcatgctcccagccggccgggtcggtgcgtgcgaggtcgaccaccatgctgcgccggccgttcacgccggcgcctttggcccacgggtcggcggtgcgcacccggttgccatcctgttgttccaccaagtagtcgtagtaggtgccgtgcaggttcccgtcgaaatggattgtccacgcgccgtcgctttgcagttcgggccggtgggcgcccaccatggcgtcgccgtcctccatgctggaacctttggtgaagaagcgcagtgtcacagacttcgccgacggggcccagattgcgaactgggtgccatggtcgttcgccacggcacccagttcacgttccagactcagtgggaacggttctgcgacacccgccttcaatccttcggattgccgtgcgagcgccatgtcgtcatcccttcaccgaaccggacatcgactcctggtagaagcgctgcatcacgatgaacaggatcgcaatcgggatcgagatgagcactgcggcagccgcgaagcgaccgaaccagttgttgatgtactccttgtcgagcatgagccacaggcccagggacgccgtgtagttctcctgggtgcgggcgatcaccttcgccatgacgaagtcgagccagggggtcaggaagccgacgatcgcttggtacacaatcatcgggcggcagataggcacgatgataatccagaacacctgccaacgtgtgcagccatcgagcatggcggcttcgtcgagcgaggtcgggatcgtgtccatgtagcccttcatcacgtagaagcccgcaccggtgccggccgaatagaccaggatgagcgcgaggatcgtcgtgccgctgctggtcaggcccatcgccttgagaatgaagtagatggcgaccaccgacatgatgcccgggaacatgcccaggatgagcacgaagttcatgaagaacctacggccgtggaaacgcatgcggctcatcacgtaggcaacggagagcacgaagaacacggagatgatgcaggtgaagactgcaatgatgaacgtgttcatgaacatgcgcgggaagtcgagtacgttgcgctgcgtgaacagcgtgacgtagctgtcgaacgaatactgcgtcgggaagaacgtgtcggtgaacggggccgtgttcttgttgaggctttcgaggaagatccatacgatcggcaacagccatatgatgccgagcacggtcagcagcacgtatgtgagcacatcgccgagaatgcggcgtgacttctgatccttccagaaactctgtcgttgcgcgttgtgcgactctgcaagctccgaatcgacgcgcttgtcgatggcctcgacatacgcctcggaggccttggtctgcgccttggttgcattactcaccggaatgcctcctcattcttgtacgaaccactgctgcggtaggtgatcagcgacacaaccgcgagcacgacgaaggtcatgatgcctatgacggcgcctaggttgtagtcgttgttgtccacggtcagcttgtagagccaggtgatgagcagatcggtcttgccggccgaatcgcccaccaccgccgggtcgccgcgggtcagcaggtagatgacgttgaagttgttcacgttgccggtgaaggtcgtgatcaggtacggggtcagcacgaagatgatgtacggcatcgtgatcttcgtgaagatctgccaccagttcgcgccgtcgatctcggcggcctcgtactggtcggcagggatgttctgcagaatgccggtcacctgcatgatcgtgtacgggatgccgacccacaggttgatcacgatgacggtcacgcgggcccatgtggcatcggtgaagaacggcatcggattgtcgatccagccccagttcatgaggatgcggttgatagcgccctgcggctggagcatctggtgcatgacgagcagcgagacgaactgcgggacggcgatcgacatcgagaagacggcacgccagaagcccttgccgtgcgtggtcttgcggttgatgaccatggccaggaacagaccgcagaagaagttgaggaacgtcgcgaagaacgcccagatcaacgtccagccgagcaccgacatgaacagtcgggccgagacgatgctgcctgaattgctgaacaccgtcttgaagttctcgaagcccacccagtcgaacagcaccagatggttgtggtcgtagctggtgaaggccatcgagatcatgaagatcaacggcagcaccgtgaagatcagaatgcccagcgtcggcagcgccaggaacagaatgttcgccttctcgttgagcaatgtgtgaatgtcgtcgagcaacgacggcgcatggccgttcttgccggcgaggcactgcgccttgtatgccgagcggatcgcaagatcccaccacagcacgaacaccgcgcacaacaccagcgtgcatacgccgtacagtagaatcagcaccgagttgtcgccggccgtatggaccagcttggcacccacccattcggtgctggcctgacgccatcccagcgatgggagcatcgcgaggttatgcgcgccggcatagatcatgaatacgatgaagccgatctcacctgccaggaagatcacgcccttggcaatctggtgacgggcgaaattacccaacccgaagaagatgatggagagcttcgtgaacacatcgccgtccttcagcgctgcgctcagcgtgtatggcgatggcgccacatagtctgcacccaacttctggcggcgcttcatctctcgttttgaaagggtgactactgaactactcattcctttcaaccgcctctctgaaactcaaaatatgtgcaggggcaccgccccatgcacggcgccgactctgcggttcacgcgacagttgcgtgcaggcgccgaaccggcattgggaatccgaataactagtgatttgaatgtgcattgtctgtgcgttgcgcacagagcaaatgtgcggaaagcccaggttcccctcagctttccgcacatatacggaccgggttcggccgtgccggcatcgggccggacgccccgcccagtcaccagagtgtgctgagcggcatcactgcttgttggcgacgtccttcttcacgcttgccatgaagtcagcggtcttctgcttcacgttgccgtcgttgacctgcttgctcaccagggccttgccgaaggtctcggctggggtccaccaggcggacatcgcggagatggtcggctgggccacggaggtcttcgcaatcgtgtcaagctgtgcctgcacgtacggcgacgtggacatgccctcgaggttcgtcagcgtcttgtcggacggaatgatctgacgcatctcccagtgcttcttctgggcctcggtggagccgaggaacgccgcgaatgccgaggcgacctcaggtgccttcgtgttcgggttcatgccaatcgccttggaaccggcgagggccttcatctggtagtccttgtcgccggccttgaaggtcgggacggtggccgcaccgtacttgtcaccgagcgccttctgcacgttcgcggcatcccaggagccggagaagtaggcgtcgagcgtgccgttcttcaaacctgcgaggccgagcgtgccgtcgtcgttggtgaagttcgggttcgcgacgagcttgacgagcgcctcggagacggcgtcggcgttcgggccgaagtcgatgccggccttggcgtcggtgcccttggggccgaacatcgtcatgcctgcgccgaggtagaacgccggaatataccaggagttcgacagcgggtaggcgaccttgcccttctcgagcatcgtgtcgagcgacttcacgtcgtcggcggagaacttgtctttgttgtagtacatgaagtacgtgttcgaggtgtacggaacgccgtagatcttgccgtcggtaccagtgaccgaatcgaccatcgtctgcgagttctgctccttcacctgctgggccaccacgtcgttgaccggggcgatggcgttctggtcgagcagatcgccaagctggtcattggcgaacatgtacacatcggcggcagcggtggggtcggtcttcacggtcttggccgcgtcaccttcggcgaccacggagttcttccacgtcaccttgtattcggggtgggccttgccgaaggcctcctccatgtccttgagccactcggaatcctcggaggggccccatacggtcaggttcgcggactgcgtttcggacggcttcgagccgtcggcggcattggaatccccgccattggcgccacaagccgccattgggacgatcatggccacagcggccgcaaggcctactgccttcttccattcgatcttcatcgatctcttcctttccttacaatgcaacaccgtgcatttcctcggcatcacgttcggggagtctccctgaaactgtttcacagtctagtcattttcgtcggtgaacgactctcaatgaaaacggtttcgcgcaacgctcagtggttatactgtagcgcatagttgcaaacgttgtcaaaaacagccgcgggacgaatcccgggcatgaaacagacgaaacggcacggactgcaacacggcagcccggcatatacggcaggagatacggcatgagcagcagtcaccaggttccgcaatggctcgaccaagccacgttctacgagatctacccacagagcttcgcggactcgaacgccgacggcatcggagacatccccgggatcatcgaacacctcgattacctgttgcaactgggatgcaacgcgatctggctcaacccgctctacgagtcaccgttccgcgatgccggctatgacatcagcgactacaagaaagtggccgcacgctacggcaccaacgacgatctcgccgcactgttcgccgcggcgcacgcacgcggcatgcacgtgctgctcgacctcgtgcccggccatacgtcgaacgagcacccgtggttccgccaaagcgccacggattcgccgaatctgtacgacgaccgctacatctggaccggcaactggatcgagggcggcgacggactgccgttcatcggcggcgaggaggcgcgcgacggcgcgtacatcgtgaacttcttcgcattccaaccggcactcaactacggtttcgcccacccgcgcaaaggctggcaggcaccggcactcggcgacgaggcgctgcgcacctgtgacgcgatgctcgacgtgatgcgcttctggctcgacatgggggccgacggcttccgcgtggacatggccgacagcctggtgaaaggcgacgacgaaggcaagccgtacacgatccgcacctggcagtacatgctcggacagattcgcggggagtaccccgaagccgcattcgtctcggaatggggacgccccgacgaggcgttcgaggccggcttcgacatggacttctacttggattggcgttgggacggcgtagccaacggctatagcatgctgctgcgcgacaccgacacccccatgctccgcgatggcgaccacagctatttcaacgccgattccggcaccagcatcgtgccgttcctcggcgaatacgaaccccggctcgaagcggcgcgcaaggcgcatgcctacttcgacctcatcacctgcaaccacgacaccatgcgtctggtgccgcgcctgaccacccgcgagctggccctggcctacagcacgatcttcctgatgccgggtgtgccgttcatctactacggcgacgagatcggcatgcgctaccgcaacctgcccggcaaggagggcggctacacgcgcacgggttcgcgaacgcccatgcagtgggacaacagcgcgaaccacggcttctcgcaagccgctgccgacgccctctacctgcccgtggacgaacgcgaagacgcgccgacagtcgcggcggccgtcgccgacggcaactcgctctggcaccatatgcacgcggccctcgaacagcgcaggagcaccccggcctttgcgccggatgcggacttcagcgtgctgttcgccgaggaaggcaggcgccccttcgtgttcaagcgcgcgaaagacggcgtctccgccattgtggcggtcaatccggggcgcgacggcgagaccgtgacgctaccggatgacgacggctccgagacgcgcaccatcacgctgaacattggtggggcggtactcgatggcacaacgctcacgctgcccccgcaatccttcgccgtgctgcagtgacggtcccggccgggcgtacgcagtcgcccggccggcgcccctcagcgctggatgaaaacgtagtcattgcctattcagtgcaatctgatgcccgacttttgcaatcggtagcataatccgccaccaacgcctccttcccgtggtatggactcgtcatcgcgctccgcaacgatatgcagccacgcacggcgcagccggcgaatccgcccatgcgcgcgccaactgccggccgagccggcgggtacagtctgcaaacgtgggcgtgaagaacacgtaaaaaccacatggatcaaattccgttcattcgcatatcttcgcggaatataaaggaaacaggcaccctcatgttatacttgcaaacgatttcatagcacgctatactgaaatcggcagcgcactccaatgacgtaactgcgcacacatgacccatatcagaaggaacgacatgtctcagatcaattcagcacccccgcgccgtgaggaaagccccgagcgactcgcacgaccgctcatccagctcgccaaggggtgcggtgtggccacctgctacatagaccagctcggcacctatgtggagattcgcgacgcagtgctcatctcggtgctcggcgcgctcggcgtcgacgcctccaccccggagctcgtcgacatcaatctcaacgcgcgacgcaacgaggcgcacgaacgcctggtggcgcccaccgtcgtcaagttcctcggcacccccgccagcacgccgctgcacaccaagcacggggagcctcacatcggactcacgctcgaagacggcagcgacgcgaccgatgccctctcgctcaccttccgcgagcatgatggcgacgtggacgtctacgacctcgcgatcggcgacaatctggagatcggctaccacacactgcatgtgcgcgatggcgaaacgggcagcgagcgcgacgtcgacgtcacactgttgtgcgcgccggcatccattccggtacccgaggccctcgcctcgcacaagcgctggggatggatgacgcagatgtattcggtgcgctcccccgaatcgtggggcgtgggcgactacggggacctgcgcgaactgctggtggacgccgccggctcgggtgccgacttcatgctcatcaatccggtgcatgcgagcgcgccggtgagcccgatcgaaccgtcgccgtattcgccgatgtcgcgccgcttcatcaacaccacctacattcgcccgcaggacatcgccgaattcgccgagctcgacgagcaggacgccgccgccgtacgcgcattgcacgagcaggtcgcgccaatgaacaccgaatcgtcgccgatggatctcgacgccgcctggaaggcgaaacgcgccgccttgcaaatcatcttcaggcagccgcgctccccggaacgtcaggcgtcgttcgaggcgttcaaggagaaggccggcgccgacctcgacacctgggcactgtggagcgtcgcattcgaagtgctcggggagccatgggagccggactcctggttccgcatgaccgccaaaagcaatccgcgcatccaggcgctgcgaaccgagcatcccgatctgtatgagttcgcctgctggctgcagtggatcgccgaggagcagctcgacgcggcccagcgtgccgcgcgcgacgctggcatgtcgctcgggctcatgcaggacatggccgtgggcgtgcactcctacggtgcggacgcatggggcaacccggaacgcttcgccgtcggctccgtcacggtgggctgcccgccggacttctacaatcaacagggtcaggattggggccagcctccgctcaacccgaactatctcgagctcaccggctaccgcatgtaccgcgagatggtgcaccacatgttcgaacatgcgggcgccattcgcatcgaccacattctcggactgttccggctgtggtggatcccggccggccagggcgccaagggcggcgcatacgtcacctacaactacgatgcgatgatcgcggtgctcagcatcgaggccacgcgtgtaaacggcatcgtgatcggcgaggatctcggcaccgtgcccgatttcgtgcgcaatgtgctcgcacgacacgggctgctcggcaccacggtggagtggttcgcccgcgtggacgactcccccaacgccggcgacccgtacgcgatgccgcagacgtaccgcacatactcactttcgtcggtcaccacacacgatctgccgccgaccgccggctatctcatgctcgagcaggtcaaactgcgcgaggagctcggcctgctcaccgagccggtggaggagttccgcgaatccgcgctcgccgaacggcaggccatgctcgacctgctcgtgcagggcggctggatgagtcaggaggccgccgacgatgtgccggacaatctgcagaccattgtcgaggcgatgcacgccatgctcaccgacgcgccttcgctgctgctgcaggccgcgctcgtggacggcgtgggcgaggcgcgcgcgcagaaccagccggggacgtccacgcagtacccaaactggcgtattccgctcgccgacgagcatctcaaggtggtgcccacgcaggaggtgttcaagtcgccgcgcgtgcaggcgctggcgaagatcatgaaccgcattaatcagtaggcgcgcatacacactgcatatcacactgcgtatgttgcatatgcgaaaggcccatgggttccgcgcccatgggcctttctcgtgccgtttttgcaatctcagtctcggcatggcttgccagcaacgccgttccatgccatggtgagggcagacttgcagtctcgacacagcaatcgccccctccctaaccatgatgagaacagacttgcaaatacgacacgagaatgcgcgctccggctgcccatctgaagatgggttcgcaagaccagcacggtaatttatgctgccgatgccgatctaagagctgattcgcaaaagcggcacgcgaatccaacattgcatcatcaatctgagagcagatttgcagatgcagcatgcgaatcggcagcgcattccgctaggaaacggatacgagtcggcaggcccgcgcacgacacgtcgaacacgggactgccggcgacatgcgcgcgcctattgccgcgtgtaccggcgcagtgcgtattcgagaatcggcacgtgcaatgcgagcatgcaaccgtaaccgagcacgacgagcaggaagagcccctgcggcatgtagaaccatgcggcgacgagcagacccacgaacacgacgtcgatcgccacgcaggcgagcgtcgcggggaagtagacgacgccgaacacgtaggcgttgcgcagggtctggccaagggggttctcgaaacgcgcctgcaaatagaatgcccattcgaagccgatggcccagatgatcgtcagcgcgaatttcggaatgagcagtggggtgatctgcagcacgatccacgaataggcgattgcggcgccgcagatgccgaagatgagccatagcagcgtcgccttggcgagattctcgcggaaggcggcgaaatagttgcgcgtgaccgtgccctggccgcgctgcgatttgcgtagcgcggtggaaccggcacacagcgcggcgccggcggtgaccacgggcagcgatgtgaccagcatgagcatgttgatccagatagcgtcggtgagatcgttccacccctgcatgaatctggagtctggagacaggaatttcatctgcgtcgctttcgtcggtgccgggcacaatctggccggcgtatagcatgcaccagcttactccagtgcagttcgggaaatctggttgatgtgaatcaggccggcatgccggcatatgcgactgggggcagcccgaaagccgcccccagtcgccttgagagagaagaggaaggaagaccagccctttacggcaccgcctcgggccctgcaagtattgaccggcctacggccggacccaacaccgccctcgcggcacagccgctcgggctggcacctgcaaacagcgcaccacgctgtttcccaagggctgactcaacgtcagccctttacggcaccagccatgacacccttgacgatgtacttctggcagatgaggtagaacacgatgatcgggatgatcgcgagcacgaggcaggccatcatcgcacccatgtcgaccgagccatagccgcccttcaggtactgcacggccaccgagatggtcttgtacttgcccagatcgagcgtcagatacggcagcaggtagtcgttccacacccacatggcctcgaggatggccacagagacgatggacggcttcatgattggcacgaccacctggaagaagatgcgtggcactgaggcgccgtcgatcatggccgactcttccagcgactgcgggatgcccttgaccacgccggtgaagatgaacaccgccagaccggcgccgaagcccaggtagatgaagcacaggccccacggggtgttgagcttcagcatgtcggcgagcttcgacagcgtgaacatgaccatctggaacggcacgatcatgttgaacaggaacagggtgtagagcagcttggcggcccagttgttcacgcgcacgatccaccatgcgcacatcgacgtgcacacgagaatgaggcacaccgagccgacagtgatgagcaccgtccagccgaagctggcgaagaagttcgtggattcaatgccgcgcttgtagttctcgagcccgacgaacgtgtcgcccaccgggaacgcgaaggcgttgcgcgagatgtatgccttgcctttgaacgagttgagcagcaccaggaagatggggaacacccaggcaatggagatcatcgagaagaagatcgtccacaatgctccgtgctttggtttctcctgcatcacgcatcaacctccttggaagtggtgatcttgttctggatgagcgccacgatggccaccaggatgaagaacaggacggccttggcctgccccacaccctcccagccgatacggccatagaatgtacgggtgatgttgagcgccagaccttccgacatgttctgcggagcgccgttggtgagcgcgaggttctgatcgtacagcttgaatccgttggtcacggtgaggaatgagcacacggtgatgctcggcatcatgagcgggatgatgatgcggaacatgacctggcggccattcgcgccgtccacttccgcggcctcaagcacatcggtgggcagcgactgcatgccggcgatgtagatgatcatcatgtagccgatctgctgccagcacacgaggatcaccaggccccagaacccgtatttcgccgaatacgtgagcgagcgctcccagtgggcgagcacgccgttgagcagcagcatccagatatagcccagaatgatgccgccgatgaggttcggcatgaagaacaccgagcggaacaggttggaaccgcggatcgacttcgtcagcaaatacgcaatggcgaacgcgacgacgttgatcactatggtggtcacgatcgtcatgagcgtggagaatccgagcgcgtgcaggaattccttgtctttgatggcgcgcgcgtagttctgccagccgatgaacttggcgtcggtgaccgtggtgaacgagcagaagctcaagtagatgccgtagatgaacggcaccaggaagccgatgaaaaacgcgacgaatgtcggcagcacgaacagcgcccaccatcgtctgattgccttaccagccatgctgatcatagcatgcctactttctcctcttcgagttcgccccacaccactgtggggcaatgccatgtcccggttcatctgcagtcactgcaaacgattacagaaccgttgtactcatacgatagcaacatcgtcatcttctgtcaaacgtttgcattcgtgtcgtgttgaatgtaatgcttcttttcacaaatcacagatctttactgcatttccagcgttttctgtaatcacatagcgtagacttgatattgaaaacgtttgcgcaaaatgtctaagcaaatcctagatcatgccgctggggccaccgacgcccgcccatgcgcgaccgctcgccggattaactgtcagccatgtggatgcaacatgtttgcaatacggtatgcacacgcggcggcaacgggcgcaatcgtatgctgtatagagtcgagcgaagcgaggcaacccgcttcccgaacaaggagggcagaggtgaacgcaagcattcaggatgtggccaaggcagcccacgtctccatttccacggtctcccggtcattcacacgacccgagctggtgtcggcggccacacgagagaaggtgctgcgcatcgccgaggagctcaatttctccacatcgcgctcggcggccgcactcaagaccggccgtgccatgcgcgtcgcgctgctcatgagcgaccatattcgcctgtggttctcggcgtccgtgatcgaaggcctcaactcggtgctgcatgccgaaggctacgatatttcgatcttccagatctccagcatcgaggaacgccgcgatttcttcgagatgctgccggtacgacgcaatgccgacgccgtgatcgtcgcctccttcgacgccgacgagaccgagatcgcccagctggcgagcgccaacgtgccgatcatcggcatcaactcggtgatgccgcgcgagcttggattcaccgcggccgtgaacatcgacgacacacagggctccattctcgccgcgcgccacctgatcaatctggggcaccgcgacatcgcctacgtgcgcacgaaccgcgacgtctcactgcacttctccgtgcagcagcgcttcgattcgttcatggaatgctgtgcaggctcgggaatctcccccaccgtgatcgtggcgcaggagggtccggatcgcattcgccgcgtactcaccgacctcatgagcctcgagcgcatgcccaccgccattgcctgccaggaggacggcattgcggtgccgctcatcttccaactcgagcgcagcgggtacgaggtgccgaacgacatctcagtgatcggctacgacaacagtttctacgcgaacgacatcggtctgaccacgattgcacaggatccgatcgagatggcgaagatggccgctgaaatgaccgtcaagctcatcgagggcgagaagcccgagcatctgttccgcacgattccggcggaacttgtcgtgcgttcgagcaccgccaagcacgtcgcctgacgcttcgcaacacccccgcctcttacgcacagggagtaagcgatccaagataaacggcgtaaaaggggacagaattagcgtaattctgtccccttttacgcatctttatgccccgccagcgaacgatcccggcactttctgcgtaaaaagacaaaaccgcaccggaatatgtccccgtttacgcagggaggaagcttttttaatgcaagagaaggaacgtgtccatatacacaaagtccatatacacaaagaggagggccaccccaatggggtggccctcctctcgctagttattcagcatgggttccacgtggaagaagtggacgcggaatccacgcccccattcagcgctcactggttggcgtgggcgttgtcgtactcggtcttccagttgtcgacgaaggccttccgcacgtcatcccagctgccggtgccctgcgcgtaggcgagcatggcctggccgagctggttctgccactcctccgacggcatcatcgtgaagttcccggcgacctgctgcttgccggatttggagtcctcgacggcctcctcgacgagcgggttgtcgctcttcaccttgtcgaaggtcttgaacggcgtggtgaagcccatgtcttccgacagcgccttgatgccctcatcggaggtgacgacccagttcaggaagtccttcgaggccttctggtcggcctcggaggccttcgcattgacgcacaggcagttctcggaactggcggtggccaggccttggttctcctcgcccttggcaccgatgtagatcgggagcatacccacctgatcgggcttcatgccggccttctgcaggtcggcccatgcccaggtgccgttctggtagaacgcggcctcgccgagtgcgaactcggagttcgcgtcgttaccggtcttcgagctcagctgagacggggcggtggtggaatccttgaggtacaggtcgaagatgttcttgaagttcggcaggtaggtgcccttgatcgtctccggctgcgtggtcacaccgtcctccttgaactcataggagagcgggatgttcgccaggtgggccttgaaacgccagtcggagctggagtcgaagcctgcggaggtgaaggcgcccttgatgccgagctggtccttcttggcctgcatgtcgtcagagacttccttgagcttgtcgaaggagttgatctccttggcgtccttgatcttggcgcccggcagctcggtgtacttcttgagcaggtccttgttgtagatgatgccgtagtactccacgacgtacggaacgcccacgaccttgtcgccgtccttcagcgcgctgtccttgttgttgagctcgttgtagatgccggtgtccttgaggtcggcggtgtagcccttccagttctggtagtccacctggccgttgacctggaagatcgtcggcgcatcgctcttggcgagctcggacttgagcgtctgctgataggtgcccgaggcggccgtctgcaccttcacctgcacgccggtcttgtcggtgtatttcttggcgagcgcgacccactggtcggcggtctccggcttgaagttcaggaagtagaccttgcccttgccgtcgtccgcgctgcttccgccacacgcggccaagccggtcagagacattgcggcgatcgccacgagacccactgttgctttcactgtgcgattcatcttcgaacctttcctcatcccacttcagccactcaccgaagtggcaccgaagtattttcctgaagccgcgccctcgcggacttcgtagccccttcattatgcatcattcctgagcagattgcaaacgtgggcagtaagtttgcgtacaaattgtggagattgccgtgcagattgactcaaaaatactttattttcaacgcttttcactgcgacacgcactatgcaagcgtttgctcacgatctgcaaacatgggcgtttcgcacagcattacgtctccagacgacacggcggggcgaccgggcaaacggtattacaatggttcctgaatttgtttccaaaaacaagaaaagagcttccatgaccgcgaacaacatgcacgacgactggtggaaacaggccgttgtctatcaggtgtacccgcgtagcttccgcgacgccaacggcgacggactcggagacatcgccggcatcaccgaacaggtgccgtatctcaagcaccttggcgtggatgccatctggctctccccgttctacccttccgagcttgcagatggcggctatgatgtgatcgactaccgcaacgtggacccacgtctgggcacgcttgaggatttcgacgaactcgtgacggcgctccacgcgcatggcatgaagatcgtcgtcgacatcgtgccgaaccacacctcgaacatgcacgaatggttccaggcggcactgaccgcggaacccggctcgccggaacgcgaccgctacatcttccgcgaagggcgcggcgaacacggcgaactgccaccgaacgactggcagtcgctgttcggggggccggcctggcaacgcgtggccgacggccaatggtatctgcacatcttcacagtggagcagccggacctcaactggaagaaccccgaggtgcatgaggacttcaagaagacactgcgcttctggtccgaccgtggagtggacggattccgcatcgacgtggcgcatggcctcgccaaggatctcgacagcaaacccctcgccgagatggacgcggactgcgtgttcgacaccgacaatcgcaatgggaacaacccgctgtgggaccgcgccgaagtgcacgacatctaccgtgaatggaacgccgtgttcaatgaataccggccagcacgcttcgccgtcggcgaggcatgggtgattcccgagcaccagcacctctacgcgcgcgaaggcgagctcggacaggtgttcaacttcgaattcgccaaggcgaactggaatgcggcggcgttcaaggtcgccatcgaagacggcatccggtcggcacacgacgcggaatcgaccaccacctgggtgatgagcaaccacgatgtggtgcgtcacgccagccggtacggtctgccgcaggtgcccaccaccggctatcacgagctgccgaacgactggctgctgcgcgacggcaccacatacatcgaagaccgcgacctcggcgcgcgccgtgcccgtgcggcgatcctgatggaactcggcctgccgggctcggtgtacgtgtatcagggcgaggagctcggccttcctgaagtggcgaacattccgtggaatcatctcgaagacccgatcgcgttccacaccgaccatgccggcgcacagaaaggccgcgatggctgccgcgtgccactgccatggcgtgccgacgacgaaccccggcctgcagattgggatccgctgttcggcaccggagcctcgttcgggttctcggacgccccggccgacggttcggcgccggccgatccgcatctgccgcagccgttgtggtacaagcagtatgccgccgacaagcagatggctgacgacacctcgatgttcaacctgtaccggcaggcgatgcaattccgccaggaacacctgacgccgagcgacgacaccgacgacatcacgtggctacccggcaccgatttcaacgcccacaacgccgaagtggtcgcctatacgcgcccctgcacgggtgagggcgatggcaccttcgcgtgcatcgtcaactttggccccgatccgatcgacctgcccgcaggcacggtggttttgagctccgagccgctcgacgaaccgcacaagctgtctgccgacactgccgtctggatgctgctcccctgagtcggcagtaatcgcaagggcagtcgcgaagtgatggcccggagggcgggccggatagggcctcgtcactggatcgcaagcgcccttgacgttcctcaaccctatccggcccgccctccgggccatcacttcgctcggcattacatcccatcacccaaatgtaaggaaagtcgcgctcccaaaccataaacgagcattaaaaggtgaggcgtcggctggggccgggccgaaaggctgaggaacgtcaagggcgcgcagcgatccagtgacgaagcctttcggcccggccccagccgacgccgtcgctgttatcaatctgcagccaaaacctagctgttccagctatagatcacatggtcgcccttgtatatgccgagcacgctgtagtgcgcggtgtcgaggtgcaacttgcgaccgaaatccggcgcgagatcgagccattgcgacgtcaggatacgcagaatatgggcatgcgccaccagcagcacgttctccccggcgagcagggcaggcagcacctgttcaatcaccgtgcgggtgcgtgcggcggcatcctccagggcctcgccctccccgttgaccacggtgatctcggaaccgtcttcgaacacctccacgcgcgtgcccgacagcgtctcatcaagtgagtgcggaccgtcacgccatacattccactcatagccggccgccgcattgagctgctctcgcgtgcggccttcggcgcggccgtaatcccactcctcaaggtcggcggtcacgttgtgctccgcgaatccggcgagctctgcggtttccatggcacgcgccagatcgctcgtgtagatgttgctcggcgtgaaaccgttagggaacgtggcgcgcagccgttcgcccgcggcagcggcctgctcgcgccccaccggcgtgagcgggatgttcgtgcggccggtgtattggccggactggctccacaccgtctgtccatggcggagcaataccaatttgcctgcagattccacgacggcaccgtcttttctctagggaacaaacttgtgcatcactttaccgtgtttcccggccgtacgcgagcgcatgcccgaatatcccgcgcgcgtacggcccgcgcgtgctctacactggtgcacatggctagaaagttgaagacagcgcccgatctgtccatggcgacggcgaaaccggtgcagtcggcgcacacacgcgacacgaacgagaaactcgcgaatctggacaacaccacgaaagagacggtgcagcggatcgacaaggtgaacaacaagatcaccgatctgcgcgagcagcgcatgcgcgaccccgacacgctgggagacaaggcattcaaactggcattccccgcactgatcggcatggtggcgggcaaggcgttccagtcggtgtggaatctggtgacgaacaaagtgcatccgagcccgaacgacgacgaagcggaccgcaaacagggcctgctcatgagcgtgctgttcgccgccgcatccgctgcgttcagcacagtcgtgaccacgtattccgacaagctcacgcagtcgatcgtgggcagactgcagcgcaagcgcaaatagcgcgtctccgtatgcggcacatgcgcagcgacatgaccgacgttgcgccaatcgactaagttgttgtgcatgtgcgcggcaccatgaataatgtgagctatggcaaagattattcacaatgacaccgtggacgtgctgctcgagcgcgtctccattcgcgccttcaaagacgaggccatcgggctggatgtgctcaacaccatcgagcaggccgcacagaacaccgcatccagccagtatctcaatgactggtctgcgattcgcatcaaggacccggcggtgaaaaccgagatcgcgcgcatctgcaatcaggattacattgcgaacgcgcccgtgctctacatattcgtgctcgatcaataccgcaactcgttgatcgcgcagtctgaaggcgtggcagtggattccgacgagttcacgctcaagaacagctaccgtttctcgcaggcacagaacgacgccgtgctcgcactgcatgccatggagacggcggcggaatcgttcgagctcggcactgtgatcctcggctcgattctcggcaatattcccgaactggtcaagctgctcgcactgccgaagtacacataccctgtgctcggcctcgcgctcggcaagccggaccagcaccccgacccgaagccgcgtctgccgcgcgatatccagttcttcgacgattcgtacaacgccgagccgaacaggattctggacggcattcgcgaatacgaccgcgaagtgcaggcctactatgacacccgcggcaaggatctctccgagcgcgcgtacagcgacatgaccacgaagaaggccacgtccaccgccgcgcttgagatgggcttcgagcacgcccgcgcgcagggcttcgacctagagaagtagctcggcagtagcgccgttagcgcggcagtctaaaacggcatgtttttcggaagcttccgtgaaaccgaccatattggggcaccccgcggcacggttcacggaagcttccgcatactatgccgcttaggcagcagtttccggtcgatcacacggaagcttccgtgcaatgcgccgttttccacggcgtctgcggtcgatcacacggaagattccgtgaaccgagccgcgcgaaagtcctcacatggcagattgagcacggtatgcgattgggcaaaagagccatccgacaccgcacaatctgttgatatcgcaaaatctgctgatttcagcgacgacggggcttgaaacccttcttgcgcgaatatggcttctgcgagcgtttgaaatggcccacggcctgcgcgagcgcgggatcgcggtgcgtcagatgccattgcccgcaatactggcactggtacacccacagctccacacctcgctcgatacggctctgttcggccgcctgccacgcggtttgccgatcatggtacatgatcttcgtcgtggtctcgcagcgtttcggcgtgaagtagtgcataaggccatactaggcggccgcgcttaccgtgggcgcactgctcgctcagcgcatgcgtacattctggcgacgttcgttgaggaaagcgcgcaggttggcgagaatggcgacgaacacgaacacggagacgacgatgagcgcccattcgccgccttgcttggtggcctccatgtaatcccgcgaaccgacctcgccatggccgaactgcacgatggacaggcagagcgccatcactgtggtgcccacgacaccgccgagctgctgcaaagtattgaacaccgcattgctgtcggcatgcagtgtcggcgcaatggcagcgagagcggcgatgcacagcaccatggcaatgatgaatgttgctcggttcgtgaatctgcggttgcaatacgatgagaccgaaatcaccaccgccaccatgagcaggtacccggtggtgagccattgcacggtggccgtggagactgtaaacagccccatgagcacagggagcagcacattcgtcatcgtttcggtgaggatgcccacaaaggccatgattcccgtggcgatgatcgacagattgagattgcgtgatatgactgtggggaactgacctaaagaaagcgcgtgggccggcattggctggctgttgaccattgttttgagattgcttggattacttggacgcgtgaggattctcggtattggtttgcgcagattccaccggagtgcgtgtgctcatgggaatgggaccgttcccggtccaactttcttggcctggagggcgatttcaagcccgcataatgccagacatactgcgggttcacgccatcagctcttgtatatgatgtgccgcatgcacggcatattgtgcagattgcacagatttatctaatataacaccgaggctggttttggttgtgtgttggggtgtgggtatgcgaggaccccgagccggtggtgccggttcggggtcctgtgaagtgtggttgcggcggtgtgctactctcccatgtcctctcgggcatagtaccatcgccgtgccagggcttagcttccgggttcggaatgggaccgggcgtctcccctgggccatggccgccgcaaaatctgttatcctgtctgcgggtggcggttcgggaaccggatcgtggacgcgagtgagggacttggtgttcgtgccgccgtgatgccgccggggttttccggcttcgtcatggtggtgttggttgtcttcgaccgttagtgccggtcggctccacccctcgcggggcttccacgtccggtctatcaaccacatgttctctatggggtctcacacacccccggggggggtgtcaggaatccttatcttggagcgggcttcccgcttagatgctttcagcggttatccctcccgaacgtggccaaccagccgtgccgctggcgcgacaactggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacgccggcaccggatcactatctccgactttcgtccctgctcgatccgtcgatctcgcagtcaagcccgcttgtgcgattacactcgacacccgattgccaaccgggccgagcggacctttgagcgcctccgttactctttgggaggcaaccgccccagttaaactacccgccaggcactctccccgacaaggctgacttgtccgggttaggcatcagatggggacagagcggtatttcactggccggctccaccacggctggcgccgcggcttcgaagcctcccgcctatgctacacaatccgcacctgatgccaataccaaggtatagtaaaggtcccggggtcttttcgtccttctgcgcttaacgagcatctttactcgtactgcaatttcgccgagctcctggtcgagacagcggggaagtcgttacgccattcgtgcaggtcggaacttacccgacaaggaatttcgctaccttaggatggttatagttaccaccgccgtttaccggggcttgaattcaccacttcgcatcccgcgaggggacgctgatggatcctcttaaccttccggcaccgggcaggcgtcagtgcatatacggcgacttgcgtcttggcatgcacctgtgtttttggtaaacagtcgctaccccctggcctgtgccacccccagccgcccacgacccgcaaggggccggcacggccgggggtctcccttatgccgaaggcacgggagcaatttgccgagttccttgaccaggattcgctcgatcgcttcggtatactctaccagaccacctgtgtcggtttggggtacgggcggcaacggacctcgcgccgaagcttttctcggccgacgggatcaccggatatcacgccatgaaagcgcccatcatcacgcctcaccccatgaagcccccggatttgcctgggggcggggccacacgcttgaccagggaaaaccacctccccggccggctacccgtccgcgtcactcctgaaacgctcaacccatgcgcgtccaggccaaacagcaacggaatcaggaggccgaagcccccatcaaccgtatcggatggcccttgttcacacgggctgttggtcggtccgaaagccggtacgggaatatcgacccgttcatccattcgactacgcctgtcggcctcgccttaggacccgactcacccagggacgacgaacgtggccctggaacccttggtcttccagcggcagggatcctcaccctgctctcgctactcatgtctgcattctcactcccacacagtccacggccgggttcccccgccgcttcgccccggtgtgggacgctctcctaccacacggccatacggccgcatccgcgtcttcggtggcgtgcttgagccccgctacattgtcggcgcggaaccactagaccagtgagctgttacgcactctttcaaggatggctgcttctgagccaacctcctggctgtctatgcgactccacatcctttcccacttagcacgcgcttggggaccttagacgacggtcagggctgtctccccctcgacgacggagcttatcccccgccgactcactgccggaatagacgcgatgggtattcggagtttggttgctgttggtacccggcacgggcccgcaagcatccagtagctctaccccccacacgcaatcaaccgacgctgcacctaaatgcatttcgaagagaaccagctatcacggaatttgattggcctttcacccctaaccccagttcatcccctcagttttcaacctaagtgggtgcggtcctccacgcggtcttacccgcgcttcaacctgaccagggctagatcatcccgcttcgggtccaggacacgcgactgaaaagacgccttttaagactcgctttcgctacgcatacaccacacggcttatgctcgccacatgccactgactcgcagactcatttttcgataggcacgccgtcaccccaccaagggggctccgacggttcgcgggcgcacggtttcaggaactctttcactcccctcccggggtgcttttcacctttccctcacggtactcgtacgctatcggtcagacaggtatactcaggcttacccgacggtccgggcggattcacacgggattccacgagtcccgcgctactcgggagacaccatccatggtgcacgcgcatacggctacggggccatcaccctctacggcccggtatccaacccggttcgcctcacgcatgcatttatcaccacagccaacggcgtcggccgttggacaggcgttcccacgacaccatgcgcgcaacccccgacgggtatcacacgcgcacggtttagccatcatccgctttcgctcgccactactcacggagtatcctctcctgcaggtactgagatgtttcacttccctgcgtaccccccgcacaagtgcggtgccagcccatgacggctggcgggttgccccattcggacaccctgggatcaaagccatgtcggcggctcccccaggactatcgcggccccacacgtccttcatcggtactgtctgccaaggcatccaccatacgcccatcacgacaaccacaacacggccgccatgaccaaagcactactgaaaaaccctagaacgacatcagatcacggggacgcaccacacacggcacgcccccatacgattacgaacgaacccaagaaaaaacaattcctcggatccgaatcacagtacgaacaccaaccccaccccaacgggcgggccgatgctcgcgtccactatccagttctcaaaccaccaccccaccaggacacccaccccgcaccaacaggcaccgggcaaccgacctgggggacacactggcaaccacaccccacaccaggggccggtggcggccagggaacccaacagcacgcaccacaccacacaatccaatacgactcttccacgccagcaagccagggcggcgacgacaaaccatcgcactcggcaaaccccagccacaaaaccgtgcacaaaaccatgcacgcccatattctccgtagaaaggaggtgatccagccgcaccttccggtacggctaccttgttacgacttagtcccaatcacgagtctcaccttagacggctccccccacaagggtcgggccaccggcttcgggtgctacccactttcatgacttgacgggcggtgtgtacaaggcccgggaacgcattcaccgcggcgttgctgatccgcgattactagcgactccgccttcacgcagtcgagttgcagactgcgatccgaactgagaccggttttcagcgatccgccccacgtcaccgtgtcgcaccgcgttgtaccggccattgtagcatgcgtgaagccctggacgtaaggggcatgatgatctgacgtcatccccaccttcctccgagttgaccccggcggtcccacatgagttcccggcatcacccgctggcaacatgcggcgagggttgcgctcgttgcgggacttaacccaacatctcacgacacgagctgacgacgaccatgcaccacctgtgaaccggccccgaagggaaaccgtgtctccacggcgatccggcacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacgggacccgtggaaagggccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactccagcccgcccgtacccggcgcagatccaccgttaggcgatggactttcacaccggacgcgacgaaccgcctacgagccctttacgcccaataaatccggataacgctcgcaccctacgtattaccgcggctgctggcacgtagttagccggtgcttattcgaacaatccactcaacacggccgaaaccgtgccttgcccttgaacaaaagcggtttacaacccgaaggcctccatcccgcacgcggcgtcgctgcatcaggcttgcgcccattgtgcaatattccccactgctgcctcccgtaggagtctgggccgtatctcagtcccaatgtggccggtcaccctctcaggccggctacccgtcaacgccttggtgggccatcaccccgccaacaagctgataggacgcgaccccatcccatgccgcaaaagcatttcccaccccaccatgcgatggagcggagcatccggtattaccacccgtttccaggagctattccggtgcacagggcaggttggtcacgcattactcacccgttcgccactctcaccccgacagcaagctgccagggatcccgttcgacttgcatgtgttaagcacgccgccagcgttcatcctgagccagaatcgaaccctccacaaaaaacattgcagaaagccaaaaacgactctcaaatccatttcaaaagaaatcagacggaccccctaataaggaaagggagccacacaaaaaacctccgccatccatcaaaacccgacaggattacccacacgaaaccatgcaggcggacaacggaactggcatcataaaagacgaccaagaaccacaacggccacgacagccgaagcgacatcaaccttggtcaagtagtacagtacacgctattgagttctcaaaccaccaccacacacccacaaccccgacccgggaaccccggcaggccgtgagcggcagcaaaagaaaaacctacaccacaacccccacccacgcaaccccaccccacaccacacacccccaaaccccaacaaacacaacaccaccaccggcgtgtcgaaaacccaacacccaagacccgaatcacccattcacgcggctgggcgaaacacgcttccgtcaccatcacaagcatcgcgcccggcacaacttacaacaccttccacttccgacttcaccatattcgcccctgattctcgcccgacctcgagaacgcgcgactacgctgagccgcagtgcataatctgcgattcatagaacgggagggaattcgaatgattatgaacaatggcttcgtccccgtggcgaccgcatcgccgaatacacgcgtcgccgatccgatggccaatgccgaactgtgttgcgatgccatagtccgcgccgcgaacgcaggagccaaggtggttgcattgccggaggtggtgctcaccagctacatcgccgatgacatgctgtgccacgacatcgtgctcggtgccgccgaggagacgcttgcacatctcgtcgccgagaccgcgaagctggacgtcgtattctcggtgggcctgccgctatgcgtgaacggcaagatctacaacacgcttgccatttgccatgccggcgagatcatgggcgtggttcccaagacctacattcccacctatggcgttgatttcgaaggccgttggttcagttcagggccggccgacgtcacctatatcaccgtcgccggccaggagcatgtgccgtttggctcgcatcaggtgttccgctgctgccagatgccgcagctatgcctgggatatgagatttgcgaggacatctgggcctgatcccccgtcgatccatctcgctcttgccggcgcgatgattatctgcaacggtcctgcatcgaacgcgtcactcgaaaaggatctgtaccgccgttcgctgatcagcgggcagagtgcacgcttgctgtgctgctatgcctactgcagttcggggcaaggcgattccaccggcgacgtgaccgtgggaggccaggagatcatcgccgagaacggcagtattctcgcgcaatccgagccattcggagatgggttcgccgttgccgacgtggacgtcgaaagcctgtggggcgcacgtcgtggcatgtcgtcgttccacgtggaaccaaccccgcaatacgccgattaccacgagaccatgttcgacatgaccattcccgatcatccgctcatgcggccggtctccaagcagccgttcattccggcggatgagaagatgcgcgcagactgctgctcgctggccgtgacgatgcaggcgcatggtctcgccgcccgcgtgggcgcgcagaatgccgatcatctcgtcatcgataccacgaactcgagtgtgacgaacacagcgctggcggtgctcgccgtcgcacgattctacgatctggaacgccccgccgtgcccgacatgtacgtggcgatctcccaggatgcgcaaaacgggcaatctgcaaacgtgaaactcatcgaacagctggcggacgcactcggcctgcccctcgccacactcgcctccgcccgcgccgagcaacagaacgccgcacagagcagcccggagcacccggtgctcgatattcaggagctgatcggcgacaccagctggcttatcgtgaatccgagcgacatgacccagctggcactcggtctgacgcagttccccttcgatctcggccgccaatatggcatcaattcgcagattgcgcacaccttcgtgccggtgattccgcggcaatatgcgcaggagtgcgcagacgggaatctgcagacgttgctcggcgcgatctgcgaccccgacaacgagttgcacataccggaacatgacacggtgagcatgagcgaaagcgcggagctcgggcctgcggttgtggaggacttctatctggatggcttcctgcgcgcccaataccggcctgcgaaaacgtttgcgctggccaggcaggcattcgccggagagtatggcgaacatgagctgcccggctggatgaaggcgttctacgagcgcttcttcggctcgcagttcctccgccacagcttgcccgacggtccgcgtatcggctcggcgggactcgacctgcgcgacggtttcatgatgccgacgtatgcgcagagcacgctgtggatgaacgaagtggacgcgctgctcaacgcggcgaccaagtgagcacgccaccgcgcgcataggcaaatggggttgcagatatcgcatatctgcaaccccatttgcttccctgatttcacggatcgtcatgcccgcaattgcgcggctagccgcttgacgtcacgacgaaaagccgatgtgtagtccgcttccaaccgcgccatgctcagattcccagcgaatcgaacatcgcgtcggcgtcctggaaccgaggcgccccctccttggccatgcgtcgcgcttcagccaacgcttccagcgtttcctcgggaacattgctgtaggacagattcaatgggatgcggcgctcacgcacgatctgccggtaaaacgcgcgcgtgacgctcgacaggtcgaaaccgaaatcctctgcgatatcagaagcctgcttcttcgtatcctcgtcaacccggaccgtgaccgatgtcatgttcataaccactccttgtccaacgtaagacagtattaagctcaagtattacaataatcaaatcatttctgcacgcacttgccgcattcagatcttgcctgagtcaggccacggttaagccgggagtagatttcggatctgacaaagtcgtcagcaagtctgccaagatgtgcgagcagcggcgcggtgcaaatgattagcagaagtaggatgacccggcaaggtatgaaatgaccccaggagaggcatgtaggttgggagaaaatagtagggagttgttgttcttccggtttggaggggtgttcatgggatgaagatcgcgcggtgtgatatgctcccccggttcggcggtgtccgtgtcgggggttctgcgttgtgcccgggatacggggaaggcccggggaacgtgtgttccccgggccttcggtgaagtgtggttgcggcggtgtgctactctcccatgtcctctcgggcatagtaccatcgccgtgccagggcttagcttccgggttcggaatgggaccgggcgtctcccctgggccatggccgccgcaaaatctgttatcctgtctgcgggtggcggttcgggaaccggatcgtggacgcgagtgagggacttggtgttcgtgccgccgtgatgccgccggggttttccggcttcgtcatggtggtgttggttgtcttcgaccgttagtgccggtcggctccacccctcgcggggcttccacgtccggtctatcaaccacatgttctctatggggtctcacacacccccggggggggtgtcaggaatccttatcttggagcgggcttcccgcttagatgctttcagcggttatccctcccgaacgtggccaaccagccgtgccgctggcgcgacaactggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacgccggcaccggatcactatctccgactttcgtccctgctcgatccgtcgatctcgcagtcaagcccgcttgtgcgattacactcgacacccgattgccaaccgggccgagcggacctttgagcgcctccgttactctttgggaggcaaccgccccagttaaactacccgccaggcactctccccgacaaggctgacttgtccgggttaggcatcagatggggacagagcggtatttcactggccggctccaccacggctggcgccgcggcttcgaagcctcccgcctatgctacacaatccgcacctgatgccaataccaaggtatagtaaaggtcccggggtcttttcgtccttctgcgcttaacgagcatctttactcgtactgcaatttcgccgagctcctggtcgagacagcggggaagtcgttacgccattcgtgcaggtcggaacttacccgacaaggaatttcgctaccttaggatggttatagttaccaccgccgtttaccggggcttgaattcaccacttcgcatcccgcgaggggacgctgatggatcctcttaaccttccggcaccgggcaggcgtcagtgcatatacggcgacttgcgtcttggcatgcacctgtgtttttggtaaacagtcgctaccccctggcctgtgccacccccagccgcccacgacccgcaaggggccggcacggccgggggtctcccttatgccgaaggcacgggagcaatttgccgagttccttgaccaggattcgctcgatcgcttcggtatactctaccagaccacctgtgtcggtttggggtacgggcggcaacggacctcgcgccgaagcttttctcggccgacgggatcaccggatatcacgccatgaaagcgcccatcatcacgcctcaccccatgaagcccccggatttgcctgggggcggggccacacgcttgaccagggaaaaccacctccccggccggctacccgtccgcgtcactcctgaaacgctcaacccatgcgcgtccaggccaaacagcaacggaatcaggaggccgaagcccccatcaaccgtatcggatggcccttgttcacacgggctgttggtcggtccgaaagccggtacgggaatatcgacccgttcatccattcgactacgcctgtcggcctcgccttaggacccgactcacccagggacgacgaacgtggccctggaacccttggtcttccagcggcagggatcctcaccctgctctcgctactcatgtctgcattctcactcccacacagtccacggccgggttcccccgccgcttcgccccggtgtgggacgctctcctaccacacggccatacggccgcatccgcgtcttcggtggcgtgcttgagccccgctacattgtcggcgcggaaccactagaccagtgagctgttacgcactctttcaaggatggctgcttctgagccaacctcctggctgtctatgcgactccacatcctttcccacttagcacgcgcttggggaccttagacgacggtcagggctgtctccccctcgacgacggagcttatcccccgccgactcactgccggaatagacgcgatgggtattcggagtttggttgctgttggtacccggcacgggcccgcaagcatccagtagctctaccccccacacgcaatcaaccgacgctgcacctaaatgcatttcgaagagaaccagctatcacggaatttgattggcctttcacccctaaccccagttcatcccctcagttttcaacctaagtgggtgcggtcctccacgcggtcttacccgcgcttcaacctgaccagggctagatcatcccgcttcgggtccaggacacgcgactgaaaagacgccttttaagactcgctttcgctacgcatacaccacacggcttatgctcgccacatgccactgactcgcagactcatttttcgataggcacgccgtcaccccaccaagggggctccgacggttcgcgggcgcacggtttcaggaactctttcactcccctcccggggtgcttttcacctttccctcacggtactcgtacgctatcggtcagacaggtatactcaggcttacccgacggtccgggcggattcacacgggattccacgagtcccgcgctactcgggagacaccatccatggtgcacgcgcatacggctacggggccatcaccctctacggcccggtatccaacccggttcgcctcacgcatgcatttatcaccacagccaacggcgtcggccgttggacaggcgttcccacgacaccatgcgcgcaacccccgacgggtatcacacgcgcacggtttagccatcatccgctttcgctcgccactactcacggagtatcctctcctgcaggtactgagatgtttcacttccctgcgtaccccccgcacaagtgcggtgccagcccatgacggctggcgggttgccccattcggacaccctgggatcaaagccatgtcggcggctcccccaggactatcgcggccccacacgtccttcatcggtactgtctgccaaggcatccaccatacgcccatcacgacaaccacaacacggccgccatgaccaaagcactactgaaaaaccctagaacgacatcagatcacggggacgcaccacacacggcacgcccccatacgattacgaacgaacccaagaaaaaacaattcctcggatccgaatcacagtacgaacaccaaccccaccccaacgggcgggccgatgctcgcgtccactatccagttctcaaaccaccaccccaccaggacacccaccccgcaccaacaggcaccgggcaaccgacctgggggacacactggcaaccacaccccacaccaggggccggtggcggccagggaacccaacagcacgcaccacaccacacaatccaatacgactcttccacgccagcaagccagggcggcgacgacaaaccatcgcactcggcaaaccccagccacaaaaccgtgcacaaaaccatgcacgcccatattctccgtagaaaggaggtgatccagccgcaccttccggtacggctaccttgttacgacttagtcccaatcacgagtctcaccttagacggctccccccacaagggtcgggccaccggcttcgggtgctacccactttcatgacttgacgggcggtgtgtacaaggcccgggaacgcattcaccgcggcgttgctgatccgcgattactagcgactccgccttcacgcagtcgagttgcagactgcgatccgaactgagaccggttttcagcgatccgccccacgtcaccgtgtcgcaccgcgttgtaccggccattgtagcatgcgtgaagccctggacgtaaggggcatgatgatctgacgtcatccccaccttcctccgagttgaccccggcggtcccacatgagttcccggcatcacccgctggcaacatgcggcgagggttgcgctcgttgcgggacttaacccaacatctcacgacacgagctgacgacgaccatgcaccacctgtgaaccggccccgaagggaaaccgtgtctccacggcgatccggcacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacgggacccgtggaaagggccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactccagcccgcccgtacccgggcgcagatccaccgttaggcgatggactttcacaccggacgcgacgaaccgcctacgagccctttacgcccaataaatccggataacgctcgcaccctacgtattaccgcggctgctggcacgtagttagccggtgcttattcgaacaatccactcaacacggccgaaaccgtgccttgcccttgaacaaaagcggtttacaacccgaaggcctccatcccgcacgcggcgtcgctgcatcaggcttgcgcccattgtgcaatattccccactgctgcctcccgtaggagtctgggccgtatctcagtcccaatgtggccggtcaccctctcaggccggctacccgtcaacgccttggtgggccatcaccccgccaacaagctgataggacgcgaccccatcccatgccgcaaaagcatttcccaccccaccatgcgatggagcggagcatccggtattaccacccgtttccaggagctattccggtgcacagggcaggttggtcacgcattactcacccgttcgccactctcaccccgacagcaagctgccagggatcccgttcgacttgcatgtgttaagcacgccgccagcgttcatcctgagccagaatcgaaccctccacaaaaacattgcagaagccaaaaacgactctcaaatccatttcaaaagaaatcagacggaccccctaataaggaaagggagccacacaaaaaacctccgccatccatcaaaacccgacaggattacccacacgaaaccatgcaggcggacaacggaactggcatcataaaagacgaccaagaaccacaacggccacgacagccgaagcgacatcaaccttggtcaagtagtacagtacacgctattgagttctcaaaccaccaccacacacccacaaccccgacccgggaaccccggcaggccgtgagcggcagcaaaagaaaaacctacaccacaacccccacccacgcaaccccacccccaaccacacacccccaaaccccaacaaacacaacaccaccaccggcgtgtcgaaaacccaacaccacacccccaaaccaagacgggagctgggctgcacacaatccgaattacacaaagaaaagccgaacgggcagaagacaccaccgatccactggtcggtcgtctccccaggcggatgaacaatcggtgcgggttgggcatctcctcgatgcccaacccgccccaaattgcagtagctactccgtcacagcgctactcggcgacttcctccacctcacgagcacgacggacggcgatctcttccttgatcatcggctccatcttctcgtacttgcggtagaagcacatgatggccgctacaatcgcgtatacaatcaccggaagccagatgaagcagaagcttatggcgttcagcgcctgctgcgactgctgggcattggcgacatatccgttcgcattcatgatctgcagcggcaggaacgcaccgaagccggagccgacctggatgcagaacgcagagccgacggctgtcaggaagccagccgcatggatgccggtcttccattcgccgtaatccaccgtatcggcgagcataccgaacggcataccgcatgcaatggccgcgccaatcacgccaatcgtccagaaagtcaacgcgagcgggacattcgagccggcgagaggcatgagcagctgcccgatcgcgccgatcgccaggccgatgatcatggtcagcgtcttgttcttgagcttgttggcaagaataggcatggcgatcgtacccactatgccgatcacctgcacaccgttgaacagtgatgtgaggttctcgttgccgaggttgtacttcgcgtagtacacagccatgccgttgcgtgtggactgcgcgatccagtagatgacgaaggcggtgacgagaatgacccatggccaattgcccttggcggcacgcagtgaatccttgaacgggatcggcttctgcacttccgggtggtaattgcgctcccggaggttgcggaacgccagcacaagcagcacgatcgcgatgacgccatagagcgcggtgaccgccatgaagccgctgcggtcgccaccgccaagcatcgtaccgaagaatccgacaagcggaatcgtgaaggcggaggtgatgaagctgccgatgttaccgccgagcatgcggaacgaattggcgttgttgcgctcgaccgggtcggaggtgagattcggaagaatcgctgtgatcggcgtctggatgccggtatagacagcacccgctgcgaggacgtaggtgacgagggcgtaccagaacttggaggtctcattcggcaaggacggtgccgtgaacgcgatgaacaccgtcaccgcgaacgggaccgcgagccacaggaaccacgggcggcactggccccacttcgtgcgtgtatggtcgacgatcgaaccccacacgacggcggagatcgcgtcggcgaagcgcgcgacaagcaggatcgtcgccgcgccgagcgcaccggacgcggagatgccgaacacatcggtgtagaagtacatgatgtacgaggagagggtgacatacagcagattgcccgccatatcggtgaacgagtagctcaccatctccttgaagggcagtttgaccctgccggcctccttggtcacctcggtggccggggaagcattgttggaaactgtatcgctcatgattgtcctttctctctttcatctgatgcgtgtgagcccatcagacgaatgcatctgcaatgtgttggacgcccgcatgcgcccatgcatgcgggactgggggagatgccgccgcgccgcgccggtacaggagcaaaccggcgttacatcgcattccaagtacggtggcaaatatagaaatcagcaaatcagcacagcgccgtgaaccagacctgcatttgcgaagcaccgcggttcgcccacgcgtggtacggaatcatctcgagacgcgtatggtcggcttggcgcgcaccgtgatccgcaggcatgtacagcggggcgtcggaagcgtcatcaggtgtgcgcagcgcgggaacactcaccgtctgcaatccttcgaggaccccagtgcctgcagcgcatgcaatgtcttcacctgcggaatcgccgatccggtaatcccacagcggtgcacggttatcgcagctctccgcacagtagaccaccgggccgcgcatcacggcgaggcgcccggcgtcgtgccgaatcgcagtgttcgcacgcatatacttcacgctcatgtcgagttcgagctccacaaccgtgcgatccgcgacctccacggaaacgaatccgtcatgcaccggcatctcgccggtgacgtcgaccccatccaccgtaaggcggtactctggggaccatgaaggtatgcgcaccttgaatatgaccggatcagcgccctccggcacatccacagtgaagcgcaccacaccctcgcgcgggaaatcagattcctgcttcacacgcacgtcgtcgaagaaccgggcgtcgttcgcaatgaactgatgtgcggcgatcatgcgttcgtcttcgcgcacggtgtacagataccggtcaacggaggcgatcaaacgggcgatattcgacgggcagcatgcgcagccgaaccattgtgcgcgttcgagcagcacatgtcggcggtcggggttgttctcggtcgcctgaacatctgcttccaaaggattgacgtagaagaaatgcttgccgtcgagcgcaatgcctgcgattgctccgttgaacagttctttttcgagcacatcggcatattcaccgcgcagctcatgctcgagcatctggcgcgcgacaaagcacatgcccaccgaggcgcagctttcaccgtacatcgtgtcgtttggcagatcgtagtcgtaggtgaacgcctcgcccacatgcgtggagccgatgcctccggtgatgtacatgcgcttgtgcacgatgttgttccacaaccgctcaccggtgcgcagcagcccttcatcgttcgtcaggcgccccacctgcatcacgcccgcgagcaggtacgccacgcgcacggcatggcccacggcggtctgctggtcgcggatcgggcgcgcggtcagcgtgtattcgtggctccatgtctccattgcggggaagattgccggcaggccctcggcatgcacggccttgttctgctcgtcgtagaaatcggggtccttgccgcgcacatcgatgaaataccgcgcgagacgcagataccgcgactcgtttgtcgcctcgtacaggcgggcaagcgcgagttcgatctccgggtgcccatcggcgccggggatcttgccgtcttcatcaccgaaattggcatcgagacagtcggccatgcggcacgcgatctgcagcgcctgctcgttgccggtgacctgccagtaggccacgccggcctcgatgtagtggcccatcacatacatctcgtggctctgctgaatctgtgagaaacggcgtcgacgcgcatagccgcccgacttgatttggaacggggtgtcaaggtagccgtctggctgctgagcgcgcgcaatgagatcgacgacctcgtcgcacagcgcctgcagttgtgcatcaggttggtatgcgagtgcatatgccgcttcttcaagccacttgtagacgtcggaatcctggaagaccatgccgttgaacggggcgtccacgtcgccggcggcgacgcgcagattgcgcactgcgtgactccattcgcgtgacaggccatcgttgacttcgccgtcgtcgttgcccgccgggtcgacggggatttcaatgcggcgttcgtcgttgatgatctgccactggtatgggatgacctcgcgggccacggattcgcggtaccggttccagaacggggaagtgatcgttacattcgccatcgccatgcctttcctgaggagctctgcgcctctttgccgagctgttaccctcaatatagaattctgaaaaacaccgtattcatgggtgcgatggttgggaaatatttccttccactcgcttttgcgattacgatggaatcatggcgaagaaagtcacattacacgacatcgcgatagcggcgaacgtggccgattccaccgcatctaaggcgttgaccggcaccggacgcatcagcgccgagacgcgccggcgagtacgggatatcgcagcacaatttggatatgccaggccagccaccaagactcgaacaggaaacggccgaaccggattgatcggcatcgtgacaccggaccgcaacggtcgttttgcgctgccgctgctcgccggcgccgaacgcgcgctcggcgcgcacaaccatgccgcattgctgatgatctcacagggtgttcctgcgctcgaacgcagccatatcaaccaattgagcgcccaaggagtggacggcctcatcatcgccggcaacacgtgcaatgcacggcacccgattgatccacgcattcagaatggtctgcctaccgtctacgcctacgacccttcggatgacccagccgattgcagtctcatctgcgacaacgagggtgccggaaggcaggcggcagaatacctgctcggcatcgggcgacggcgcatcgcgatcgtaggaggcttggacttcttccaggcgacgatcgaccgcgagcgcggtgcccttgacacactacgcatggccggggcggcgccgctgctcgtcatcaacgaccggtggagtgaggattggggcgaacgcgccgcccaactactgctcgaacgcgatgaaatgcccgatgcggtgtactgcctcaacgatgagatcgcgcgcggcatgtgccgtacgttgcagatgcacggtcaccgcgtgccacaggacatcgcggtcatcgggcacgacaattgggactcggtctgcgtgaacgtgcatcccacactcacatccttcgacaacgaattggaaaccatgggacgccgtgccgcacggcatctcctcgacgcgatcaatgggcgcccgcaccacggtgtgttccaagtggaaagccggctcgtcatacgcgaatccaccgatgcgacaaggcacgatccattgcacggttccggatggcgcgcggggctcgaatagacggcgcgcgtggtaagcctgtaatcaacgcaacacacacgccaacaatcaggaacaggagcgcagcacaatgacgaaacagatcgtggtactcaccggcgcgggaatctccacctcggcgggaatcccggacttccgcgggccggacggcgtatggaccaagcatccggaccagatgcaggtgtacgacatcgatgcgttcctcaccgacaaggaggcgcgcgaatactcctggcgttggcagaaggagtcgccggtgtggaacgcgaagccgggcaaagcgcattacgcactcgtcgacctcgagaaagcgggcatgctcagtctcatcgccacgcagaacttcgacgcgctgcacgaaaaggcggggaattcgccgagcaagatcgtgaatctgcacggcaccatcggcacgtcgcactgcatgaagtgccatgcgaaatacgacaccgcagacatcatggcacggcttgacgaggagccggatccgcattgccatcaccagctgccgtaccgcgggaacatgccctgcaacgggctgctcaagacggacgtcgtctacttcggcgaagcgctgccggaaggcgcgatggaacggtctatccgcgccgcacagcaggccgacgaactgtgggtggtcgggtccacgctcgaagtgttcccggcggcgtcgattgttccggccgcggcgcaggcgggagtgccgatcaccatcatgaacatgggccgcacacagtacgattcgctcgccacgcgcctcattcacgaagacatcgcggtggcgctgccggagctcgtgcagcggaccatcgcagacaacaggtgagcgcacggcgttcccgcacatagtattgggcccgcgttccagtgcacagaacgcgggcccaatacattgcttggcaacaaacgtaccagattagcagataatcgccggtgggcaatctgcagaccggcagatgaaaccgggcggcgagatcgcggaatcagtagattcgcttgggtgaataaccggcatcgcgcagcatctgcatgacctgttcgatatggtccgggccgttcgtctccacggtcacaccgagcgccaccgagttcgtgtaatggccgttcgccttgaactggtcgtgatcgagcgcgatgacattcgcgcgcgccttcgcgaggatcgtggcgaccttgaccagctggccgggggtgtcgggcagctcgacctcgaaattcatgatgcggccgcgcgcgatcatgcccttctggatcactgcaccgatcgtcaccgtgtcgatgttgccgcccgacatgatcggcacgacgacgtgctctcccggcgcctccgcgaacttgcgcgaacgcagattgagatgttcgagcgcggcgagcgaaacggcgcccgcggcctccacgaccatcttgtgcttctcgagcatgagcaggatcatctcgttgatatcgcgctcggagacctccacgaggtcgtcgaggaactcgttgagcagcgcgaacgtgagatcgccgggacgacgcaccgccacgccctccgcagacgtgaccaccttgtcggccggcaccacatggccggcgtcgaacgacctgcgaaatgccggcgaaccctcggggatcgcgccgatcacgcgcacctcggggcggaacatcttcacggcgagcgcgacgccagcacccagaccgccgccaccaagaggcacgacgatgtcggtgacacccggaacgtcttcgagaatctccatggcaatggtgccctgcccgcacagcacctcataatcgtcgaacggcggcacgtagatcatgccctcacgctggctcagctcgatcgcgtaggccgcggcctcgtcgaacacatcgccgtgcagcacgacgtcggccccatacgccttcgtcgcgtccaccttgagcggcggcgtgatctccggcatcagaatcgtcgccttcgccccacgctcatgggccgcataggcgacgccctgcgcatggttgcctgccgaggcggtgacaataccgcgctcgagctcctcgtcggtgagcgaggcgatcttgttgtaagcgccgcgaatcttgaatgaacctgtgacctgcagattctccggcttgagcaggatcgtgtgcccggtcatctccgacagcaccggcgacgcgatgatctgcgtgtgctttgcagtcccctcgagtcgttcggcggccatcttcagttccgcagcgtgatccctgcgcattgcttgcaacacatctttctgttccatgggagccaagtttaagaaaaaaccgcgcgtgcgtcacactctgtccgactgctgacatagttcgtcttccagcatgaacagacgcggccctggttcccgcattcgatgtgtttcacgggaaacaggaccgcgctcagattccgtttgcgaacgtcagcgtcagagttcgacgacgacgccctcccagccggcgagctcgccgtttgccaaggatttcgcggagtggatggcatcgtatgtgctcaggatgatccggtcttcactcacgccgtcggcgagcagatccgcgaccggcttcggcagcgcggcatgccgaccagtcagattgatcgccaccagcatgcgctccgccgtgccgtccgcgttcgtcagcgtgcgcgtgaacgcgtagacctgctcgtcatcgtcgtcgacgagcgcccattccccggccgacacaacggcactgttatgccgcagattgacaagcttcttatagaatgcgtagaccgaatccgggtcgtcgaactgtgcggcggcattgatctccacatggttcgggttcaccgacagccatggctcggtcttggcgtcagccgcggtgaatcccgcatatttcgaaccatcccactgcattggcgtgcgcgcattgtcgcgaccgaacagcgcgagcgaatccatcatggactcgccggactgcaccttcgcctcttcgacgcgctggcggtatgcgttgatcgactcgagatcgcggtactggctgagttccgtgaaatgtgcgcccgtcatgccgagctcctcgccctggtagatgtacggggtaccgcgatgcagatggatgagcatgccgaaggccttcgccgaatgcacacggttctcctcattcgaatcgtcgccccagcgagtgaccacgcgcggctggtcgtggttgcaggtgaacagactcgcccacccgcggtcgtgcacggcctcctgctgcgccttgagctgctcgcgcaggtggcgcacatcgaacttgacgatgtcccacttcgaatcgccctggtcaatgcccacatggtcgaacaggaatagcatgtcgagttccttgtggtctggatcggtgatgtactcgttacgcgcagcgtccacacccggcgcctcgccgacgttcatatagccaccgcgcttctcgaacacctcacgacgcatctcctgcaggaactcatcgatgcgcgggccgtcggaggagaacgggtacgggctcgagtacccttctgggccggccgggtagtcatcgatctcggaacccgcttcgcccggaagacggccgttcttgtcgaccaccttggagatctgcgtgatcacgtccatacggaagccgtcgatgcccttatccatccaccagttcatcatggcgtagacggccttacgcacctgaggattctcccaattgaggtccggctgcttcttcgaatactggtggaggaagtactcgccacgcttggcgtcatactgccatgcggaaccaccgaagtaggagccccattcgttcggctcggcgcccggtgcccccggttccatgcccggtttggcggggcgccaccagtaccagtccgctttgctggaattggggtcgcgagactcctggaaccatgcatgctcgtcggaggtgtgattgaccacgaggtccatgatcaccttgatgccgcgcttgtgcgcttcggcgagcagctcgtccatgtcatccatcgtgccgaagatcgggtcgatggcctcatagtcggaaatgtcatagccattgtcgtcctgcggcgactgatagaccgggctcagccagatcacgtccacgccgagatcggcaatgtaatcgagtcggctcgtgatgcccttgagatcgccgatgccgtcgccgttagaatcctggaaactccgcggatagatctggtacaccaccgcgttcgcccaccacgggttcggcgtcgcgccgttcgtacgcacggaatcgggaagcacaggcctattcattgtggtcatggaagctcctttgcctttgaataacaaccgccaacactatagagatggctccatagtaggcacccctgaattaattgcctagcgtagtatgcggacgggcgtgtgggaaagtaattccgcggtcacatgcacgggaatcttcgcaaaatcgaccatatacggcgtttgcgcggcatactttacggaagtctccgcaaggaatgccatgctggagcctctttgcggtcggtcatgcggaagcatccgtaaaccatgccgcggcggagtctgcaaatgatgtatcttacggaacgctccgagaaccatgccagcaaaagacgtttttgcggtccgtctcaaggaaacttccgaaaaccatgccacaaagaagcgctattgcggcgcatcttacggaagcttccgaaaaacacggcgcaaacgggtacccctgcggcatatctcacggaagactccgcacaatgaaccgcgaagagaacaatctgcggatcagtttgcggaagactccgagaaacaaaccgttttgagaccaccgcgcggtcggtcatgcggaaggttccgagtaatggggcgccacagcggcaatctgtggcacgtcgtacggaaggttccgagaaacacaccaaggaggaatccagaaatggcatatcttacggaagcttccgaaaaacaagccacaaacaaagcgcaaaacagcacttccaagcgcccataggcgctgaatacggtggacaacggcgaagttatccacaaattccaaatcgggattgcacgacattcgacactctcctaccgtcgaaagcatgaagatagattcgcaaatcgagcgactcctcgacgagtcccagaacgcacaccgatgcgcggtgacgaccgacgtcaacctgcgccgcaaactacgccgcagatgcgaaagcggcgaattgaccatgccatatccgcaactgtttgcgcggaaggaaacttgggatgcgctcaatccgcgcgagaaaaagagacatgtcatactcgccctggcaatggtgcgccccgactggattttctgcgcacagagcgcggcttgcctgtacggcatcgagcagtcgtaccagattcacgacaatccgatgatccacatcgcatccacacacgaaagcggcatataccgggccaggcggagtgatgccgtcatacaccgcgtgtacacgccaaatccgcaatacaacgtgatcaatggagccaaggtcaccacactgccgtgcacaatctaccaatgcgcgctcgtgctgccgttcgaacagatactgccgctcgcagattccgcagtacgcagcggtatggcgctcgacgatctgcgacagttccccgttcacagcgcgaccgaggcactcgcgatcggcaacgtgctcgaatacaccgacccgcgcagtgagaacggcggtgagacgctcgcaagaagccgattcatcgaacgcgggctcatgattccgcagctgcagaaggagttcccgaatccgcagaacccggaatacccgttccgcgttgatttcatttggattctgccgaatggacgcatgatcgtcgccgaatacgacggcatgacgaaatacggcaatgaccgcaagaccatcgcaaaccacgtgcaccgggagaaactgcgcgacgaagcgctgcggcaacacggcgtcaccgcgatcatccatttcgattatgaggatttgctcaatcccaacgaactcattgccaggctcgtcgccgccggtgtgccgtaccgccgctgagcatgcagcggatctggtcgcggcatggtatgcggaagattctgagaaccgtgccgcaaacgtagacttttgcggtcgatcatgcggaagactccgtaaaccgtgcctcaaaaggcatcccgcgcggcacgtcttacgggaagttccgagaaaccggccatcggacagtctggaaactgcacttcctaagggcgcctccatgaaactggctgcgaaaggagcttatgcggcatggcttacggaaggttccgagagtcgtaccgcaaatggagacttccgcggtcagtcttacggaaggttccgtgaaagcgactatattcaggtcactttgcggtcgaatatacggacgactccgaaaaacagaccacgaaacggggtctgtgcggtacagcttacggaagactccgagagctgtgccgaaaatacacgcgggcgccggattatgtgagagtctgcaatatgcgcagctcgcactcgccataatgcagcgtgagcgcgaggtcttcgccgacgctcagatgcacgcgctcgccggtctgcggatcgaacaccgtgagaggagattccgtcgcgcgaatgtgggcggtctgcggggcatcggcgttcaatccgacgaacagcagcacctcgtcgccgcggaacgtattgcgaatgccgagcggaacgtcaccatgcaccgggtctgcgagcagactgtcgagcaccggcacgccgacgccgtccggatgcgtgagattgccgtcagcatcgaacagcggggcgagaggagcggaatcggtctcgccaagcttgtcggaacagtagatcgggccaccgcttatccagcgcaacagcatatgcgtgcgcgcgtgcgggtggcgggtccagaacatatcccagtcgcagtagcagagacagcctatgagcagcgaacagtacgcgttctcgatggcatgctcggcgagcgattcgggaatgttcgggaagaagtcgtcgctcgtacgggcgactccctcagcacagcgctgccaatagttctcgggagtcatgcccatgcagtggatcacggcgagatgcgcgtattcccaatcaccattgtcatcttcgtgacgtatccagttggtggcgtattccacggcatcatggcgaacgcctagagacgcataggattccaggccgcgcgtgagcacaggaagtgtgccctgcgaatccaccttcacgaagtcgatgccggcggcgtccaagtgcgtgttccatgtacgccagaacagcgctgcacactccggattcgcagtggggattgccatgccattgggcagtgtttcgaacgcggatcgactcacgaggagcttggggtcctcaacgcgcgcgtccccatccgaatacccctgcttgtagtactcgcgccaatcatcgtcggattcgggcttgccggcgagcgcgtccacatccacgccacgccaatacccttggaacgcctgccatacgccgacgtaccgcacgccgaagtcgtgtttgagcacgtcaatggtgtgcgagagtccctgcgggaagcgcgttgtgtcggcgtcaaaaccggttagcttaccgttctcgacttgagaccaaccgtcgtctatgagcacccacgaaacgggcacgtgtttggcggcgaactcctccattttggcgataatggcctgctcgctcacgttcgtgccgagcgagtcccaggtgcaccagccaaaaccgcgcaacgattccggcagagtctgcttccacaatctccccaagccaccgttctgcaacatgacccactccgcgcatccccgaatcagctcgtaaggatcctcgactttccgatcgctttgccgatggacgagcagtggcccctgcaattgcacatggccaacctgattcgtggagacatcgagcagcaagtcattgtcgcctcgcccatcgccgcgaatgtcaacgcgcatcccgtgacagaacaccggtatcatcacatgccacgccttcgccgatttccacagcaccagctgggtgcgctccggtatgtcacagaaacgctcgacccatgccggccgcatccaccattccttgtgctggtaaaggcacagaatcggccccactggcttcgatctgcctaattgcagccgtacggacaccgaccgcccggccagcaatgtgggacgctcgagaatcggattggattccggaagctgcgcacttatctccgtcaccgttgcgctacgcagtgtgcgccacggtattctgtgttcgctcaccgagtccgggggcagttcgacttcgccgtgctcatcgaacggcccgcattcggtatgcgccaccactgatctcaccgttatcatgggcgtctccctcctgccgttcttcgttgacctgcattggttcccgccacaataaccggctttggctgccgtttccagcccgccacgccgagcgtcattaccccctcagcgagacagcagcgcgcactgcctaacgcgcatttgcttgcaactccggtctcgcgcgagcaatcactgacgtgggcgacccggctgcgcgccgttcatgcaactccagtctcatgcgggcaatctgatatgcaattgggtgtcgttattgcaaatctgggctcagattggctcttggatcgcagattatctcgccgtatttgcaaacgcagtctcatcatgggcaactatgacgcgtctgccgggtcccagcgagaccgctgctgcaggacaggcaatctaggagcgcgcagacgtgcctttctcgcaaacccgactatggcaaggcgctcgcgaaccgcttgccgtgccatatttgcaaactcagtctcaatttgcggattttaatatgcagatacagccacagattctcgcactcccggatgcgcatctgcaatctgcgtaaatgtgtaaaaagggacatcgcagacccgtgcacgtccccaattacgcaaaacaacagggcaacagaacgcaggcgatcgccgccggaagacgcggtgcccgctacaactctgcgggaaagaactctgcgtgaaagggaacgctagctctgcgtaaaaagggacatctccgacccgcagatgtcccaaattacgcaaaggaagaaaaggaagaggggaagcagaggcaaagaattactgaaagtaatagtctgcgtaaaaggggacagacagaacgcctatctgtccccaattacgcagatgcgctagccgcccatgcgccactccccgcccatgcgctacccgcagacgcccgctcgccgctccactcccgcagcgcaggcggcagaacgggtcgcgggttacttcacggcaccgcgcatcacaccgccgacgacccacttctgggcgaagatgtagacgacgagcacgggggccatggccatcaggtagctcgcgaacgcctgcggatagttcgtggcgaactgcgagctgaacacatactgcgcgagcgggatggtctggttgctctgatcggtgaggatgataagcggcagcaggaagtcattccatgcccacagtgcggtcatgatcgcaatcgtcgcgttgatgggccccatgagcgggaagatgatcttccagaagatgcgccatgtgcccgcaccgtcgatgcgcgcggcctcttcgagcgacaccgggattgagcgaatgaatccggtggcgatgaacaggttcgtgccgaggccgagaatcacgtacaggacgatcaggccggcctggttgtcgaggtgccacgagcccatctgcttggcgagcggcagcatgaccaccgggaacggcacgaacatggcggcgatgaagaagtagtagaggaagcggaagaaacgcttgtccatgttgcgcgcgatcgcgtaggcgacgaaggtgttcgtcacgagcgtgagcgagacggcgagcacggtgatgatcgccgagttgagcgcggcgcgcgggtagtccactttggccgaggcggccgcgaaattgccccactgccagctcgtcggcagcgagaatgtgcccgcctccgccggcgtcttcaatgcggtgaccacggtgaaatacagcggcacgagaatcgtgaggctgaacacggcgacgaccgcggtgagccaccagttgatgcggcggtccttgcggaacttctccgctttggccggcgcggtattcatggttgcagattgttgcgcagactgctgcgacatggtgtttgcggttgcggtggtcatggtctcacaccttttccttgctgccgaagaacttgagctgaatgaacgcgatgatcgcgaggacgatgaagaagagcacggcgttcgccgtctggtatgcgtactcgccgccggtgagaccgcccttccagatgaggtaggtgacggtctcggtcttcgagttcgggccgccgtcggtgagcgcgacgacctggtcgaaggtgccgagcgcgttcttcatggtgagtacgagattgattgtgaagaacggtccgatgagcgggaacgtgatcttccagaacttctgccaggcgttcacgccgtcgatcgcggccgcctcgtagacctcggagtccacggtctgcaagccggcgagatagatgagcaccgaataggcgacgccctgccacacggcgaggaacacgatcggaatccacgcatagcgctcgctggtgagcagcgactcgctcagccagccaatgccgagcgccttgccgagctcgggcagcggctgcatgaagatgtacttgaacacgtagcctatgacgagcacggccagcgtgtacggaatgaagtagattgcgcggaagccgttcttgcaggcgatcttgccgttcagcgccaccgagaggaacaatgcgatcacgttgatgagcacggtgatggcgatggcgatgaggaatgtgaacagataggcgtggccgacccgttcgtcgcggaacagggcgaagtagttctggaacccgatccagttgcagctgccgtacccttgcgaattcgtgaacgagtacatgatgccgcgcacgaagggcacatacaggaacaccgcgaagatcacggcggccggaacggccatccagtaataggcgtggtccaccttgcggcgcgagaacgcggagaccctgcgtttgcggggcggtttgcccgcgggtgtgcgcgagtgatgcgtgtcgatgtcattcgcaagcacgtcctccatggcgcgcgcctgctggtcggcattggccaacgaagtcattttgctttccttcccttgtatcccggccgcagactacttgcggaagtcacgagcctggaccttgttccactcgttctgcatggagtcgatgaactggttcacgttgccgctcatgatcgcggactgcaggtagccgcctatgttgatggacgacggaatgtagtggtcgcagaagtccgccacacggttgctctcgaagaacgggcgcaccggctcgagcgccttgttgccgaaataggtctccttgagcggcgtgatcgcggactgcgcgtcggcgtagttctcgagctgcttcttgctcatgaggaaccgtatgaagcgcatcgactgttccttgtgcctgctgttcgcgcccattgtgaggatcacgtcgtcgccggcggtgaggatctgcttgctcgcatcgttcgtggcgggcatctgggcgaagcccaggtcgatgtctttgttgaccatcgtgatctgcggaatcgcataggtaccgagcggaatgatcgcggccgtgcccttggcgaagttctgcgtgccttgctggtaggtgacgcccttctcgctgtctgcatacttgaacagttcgatttccttctcgatcggttcggtccagatctgcttgaacgtggtgtcaccgcttttcagcgcggcatattcgctctcgggaaccaatgtgccggcaagcgaggcgaggggcgcctgcgtggtccaggcatcggcgagcgtggcctgcaccgggttgatgcccgcatcacggaatttcttgagcatggcaatgaattcatcccatgtctgcggcggattgtcggggtcgagaccgaccttgcggaagagatccttgttgtagatgtagccggaggcattgcccgcgaacggcaggccgtacagtctcttcttcgccgggtccgaggtctgcacgaggttcttcgcgatgttcaccatgccctcgttgagttcgctcaccagcgggtcatcggtgaaatcatggaacaccccggaggcggcgaaggtgccgaagctgtagtcgccgttgaaggtaatcacgtcgggcacgcggtccttcacgaaacgcgtgcgcaggtcggtctgcgcattcgccgagttgttgatgttgatgcgaatgtcggggttctctttctcgaactcctgtgccgcctgcttgaaccagtccgcggcctcggccttgaactggaagaaatcgagcgtgacctgcccgctgccggcactgttgccgcagcccgccgcgcccacgccgaccgccaacgcgcacaccgccgcgccgatgccgcggagcatgcgtcgcatggccgaacgtctcatccgtgttgcgaacttcattctgactcccttgtccatttccactttccatcgccgatggctcccttaccccggctgacggttgccagtgtatggaaccgcccttttcattcccacctataccccgcgtgccttgaaacagtgtaagtaattggcgtatatttatatactcatggaaactaattcggattcgcttgattttccacgctggttcagtcgttcggatgctacgcataatgtggcgcgcggcatcatgcaatacggcccgatcgcgcggacgccgctcgcgcagatcttcaatctgtcgcagggcgcgctctcgcgcatcaccagcgatctcatttacgacggcgtgatcgaggagatgccggccggcagcacgcaggcgggcagattgccgcagggattcgacctacgcgaatcaagtgaacgccgcggccgcccgcagaccgcgctgcgcattcgcgaggactcgcatgccttcgtcggcgtcaacattcacgacggcgccatcacggtgtccgaggtgaacacgatgtgccgccccatcggcagtgacatcaccgaaaccgtgtcgaacaccgccccacaggccgtggtcgagcagatcacccgcatggtgcgtgaactcgtcgccgcctcccccgacgcccccgcgcccaccgcgcttggtctttcgctcggcggccacgtcgaggacgaccgttacgtcaccttcgcgccgttcctgtactgggattccagcgttgacctgggcggcatgctgcagcgggacaccggcattcccaccaaggtgttcaacgacctcgactcggtgctgctgcacgaatgctggttcggcgacgccattggcgttcccagattcgccgtcatcacgatgggcgccggcgtgggctattcgatctccgaccacggcgacccaatagacaaccccgacaaaagctatggtctggccggacatgtgctgatcgacccggaggggccgcgctgctcctccgggcatatcggctgctcgcaatgcctgacgtccgactcgatcgccgaggaatactcgggcatcatggggcgtgtgaccaccttcgaggagttctcgcacgatctgcgggcgaaccggccgcaggcgcgcagactcgccgaacgcacctgctaccggctcggcgtgcttgtggcgaccgtctcgaatctggcgatgccctcacgcgtgctcgtcagcggggaaagctcgttcattgcgaagaagaaccgcgagttcattcgcaagggcatcgatgcctaccggcacagccaggccgcgccggtcgaattctcgattccgcggttcagctggcggctgtggtcggattccgccgccgcccgcgccatcgccacctacattagctagcgaaggcgcggccgcaatggcgtgctacacgcgcgtcacgctgaacagcaccgcgttggcggggtgaatgctcggcggtcgcagaccgtagcttgcgagtgcctcgccggtcatctccacgccgttcgcattccaccaaccgagttcgctctgcccgttgccgatctcgccgaagggctcaccactcgccatgttcagtgcgagcgggcgcacacgataggtggcctgcgcgtcgagtccggggagcgcgatgggcgcggccgggtaggtctgcgacgtggtgagctgggtgaagcggtagacggcacgcgcaccatccgcgctgatcacaccgtccacgcgcacggtcgggtcggctgcatcgtcatgcacggcgacgccatgttcgaagtcgacgcggtgctccttgtaggcgtgcacccattcgcccaacaggtcgaggtcgtgctgcggctccttgagcagattccattcgatgcccagatgcccgaagaacgccatcgccatgcgcatctcctgactcgtcgcgcggtgcgtggagtgcgcggggctggcgccgacatgctcgccaatcatctccggaggcacgagcagcgacgtgtagcgctggatgtcggcgcgctccaccggatccacgcagtcggaggcccagatgcggtctgcgagctcgagaatgcccatgtcgacgcggccgccgcccgacgagcagctttcaatctccaggccggggtgggaggtcttcaagtcgtggaacatgcggtagacggcgagcgtctgcccatggaccgcgcagctgccggtgcgcggggagaccgcctcggtcacgtacttgttgtggtcccatttgatgtagtcgatgccgagctcgccgacgagcgagtccatgcagccgtacacatacgcatacgcctgcggattcgtcaggtcgacgacctgctggttgcgcccctgcatcggcaggcggtgcgcggtgggcatgagcacccagtcggagtgctcgcggtacatcgcggaatccgggttcaccatctccggttcgaaccacaggccgaactccattcccttggcatgcacgtagtctgcaagcgccttgagcgagtgctcgccgtcgggccacacgtcctgggagatccgccagtcgcccaaacccgccgtgtcaccacggcggtcgccgaaccagccgtcgtcgaccacgaagcgctcgacgccgctcgcggcagccttgtctgcgagcctgacaagcgtatcgtaatcatgctcgaaatacacggcctcccaggtgttcaggatcaccggacgcggcttgtcggcaatgccatgctcggcacgccaacgcgcatgggtggcgcgcaggtcggcgtggaagcgtgcggcgacttcgttgagcccctcgccgaaggaaccgtagagccacggcgtggtgtaggagtccgcggcatcatgcaacgtgatctcaccgcccgcaagcacttccgcgccgccgatcacaccggtcgtgtatggcaggcgctccgccgccatgagtgaattgccgctccacgccacatgcaccgcatacacgtcgccatgcgtgaagccgaagccggggcgacctgcattgagcagcagcgaagcgtcgaagtcggggcgccccaccatgctcgccttctggaaccgaccgatcgtcagcggctggcgctgcggtgaacgttcacgcaaatgatgcccggtggtggtgagcaactcggtcatgtcggccggcaccgggaaaccgagttccaccttgccgatctccagactccccgcgcccagattgcgcacgtccgcgcgctgacgcaccaggccgctgtcgcgcatctcgcaggtccagatgatctcgaccccctgttcggcatcgctggcggtaacggcaaccccggcgtcacccaccgcgatgtcggtgacgacgaaacggcagaagagctccacgccatcgcgacgcaccacgaaacgcggctcaccggtccatgcctcggcctgcgtgggcagcacgctcggccatgtggtctcgtcgagcgcgccggagacccgttgcgggcgcagggcgtccactgcgctcaccagcgtgcgtggctgggtgagggggcgcccccaatgcaccacacgcggcaactcgtcggccacgaacgcgagcgcgaacgccgaatccgcgtcgtggttctccatggagaccacatgcaatgcctcgccggcgtgcgtggtcgcgttgaattcggaaatccgtgtcatattcccctttcggcatgcgtcgttgcaatgtgactacgctgccatgctacgcaatcgcgcattccttgccatgccatggtgtgttccgcgcacacggcaagtaattcggcatggatcaggcatgccggcgactgtggaagaactcggcgagcaatgccgtgcactcgcgttcgcacacgccgccgtacacctcgggctcatggcccacatgcgggtcgcgcggaatgtcccacaccgaaccgcacgcccccagcttggcatcccagccgccgaacacaatgcggccgatacgcgtctgcaggcaggcccccgcgcacatcgggcatggctcgagcgtgacgacgagcgtgcaatcggccagattccaattcccgcgcaccgctgccgcctcacgcatcgccacgatctcggcatgggcgagcggatctgcatcgcgctcacgcagattgcgcccgcgtccgatcacctcgccgtgcgcatcgagcacgaccgcacccaccggcacatcgcccgcggatcgcgccatccgtgcctgtgcgagcgcctcgcccatcgcctctgcgtattgtgtcatcgcgataccgcccctgcctttgtatgcatgccatcgtccgcccgctcgcatgccgagcgcttccactgttcgacatctggctttgctacgctcgcagacgacggctctgcttatacagcatactgagaccagacagcatattagaagatcggccatggcccatgccggctgcagaccccgcgcatacagaaaggaagcctgtgagcgttctcattctcatcctgtgcattctcggcgccgtgttgctctcctcgttcctgagccgcttcctgccgcgcatctccacgccgctcgtgcagatcgtgctcggtctcatcgcctcgcagatgccgttcttcccggatgtgcaactcgacccggagctgttcctcgtgttgttcattgcgcctctgctctaccttgaggcgcatgagatcaacaagagtcagctgctcaaatcgcttaagctgtcactgtcgctcgccatcggtctggccatcttcacgatggtggtcgtcggattctcgctgcacacgctctggcccatgttcccgttggccgctgcactggcgctcggcgccgcgctcggccccaccgatgcggtcgccgtgagctcgctgagccatgaggccacgctgacgcaacgccagatcggcgtgctcaaaggcgaatcgctgttcaacgacgcctcgggcatcgtcggcttccagttcgcgatcgccgccgccgtcaccggccagttccgcgttggcgaggcagcctgggagttcctcatcaccttcttcggcggcgccgtattcggttgcattgtgggcgtgctggccaattgggtgttcgaatcctcgcgccaactcggctgggagaccaccaccacacgcattctcatggaattgttcctgccgttcctgctgtatctgggcgccgaggccgtgcatgtctcgggcattctctcggtggtggccgcaggtctcgtgatccgtttcgaccgcaccggcataggcccgaacgtggcccggacgaacatcgtcgcctcaagcgtgtggtcggtgctctcgttctcgctcaacggcgccgtgttcattctgctcggcatgctgctgccgggcgccatgcgcgcgagctgggataacccgatggtgagcaactacacgctgctcgcggtcatcctgtgcgtctcgacgctcatcgtcggcctgcgattcctatgggtctcgggcatgctgcgcctcgcccgcgcgcaggattcgcacaagcgtcgccgcatgacgccggaacgctggcgctccgccgccgtgatgaccttcggcggcgccaagggcaccatcacgctgtcgttgatgttcacgatcccgtacaccattgccgatggcgaatggttcccgatgcgcgacgagctcatcttcatcgccggcggcgtgatcatcgtgacgctgctgctttcgaacttcctgctgccggtgatcgcgccgaacaaggcgaaggacgtgccccgcgagaccaccgaggcctccatagaggtgctgcggcgcacggtggaggaattggcagaactgaccaccgacgagaaccgctccgccgtgatggtggtgatcaactcgtacacccagcgcatcggccggctcaagaaccagctgggcaccatagacccttcggcacgcatcgaactgcagatcgacgcgctcaactgggagaaggagtacgtcaagcgcaagctcgccgaattccgtctcgaccccacgctcagcgagcgcgaacgcgaggtcaatgtcgaggcatgcgaacgcctgctcgaccagatcatggacacgctgcgtcacacgaacacgaaacacgactcctcgcacgtggtctggcaggtcaagggacgcgcccatttggcacagcgtcgtctggtcctgctctcccgccgtgccgccaacacgattcgccgcagcacgccgctcgtcaacgaaaacgagatctacgcgagtctgcgcaatctggaactcggcgccttcgatcatgtgattgacaggctgtacgaggagatgagcagcaacacctacggcacggagtatgtgtcgtcgctgctcatggattaccggcgcgcggaggcggcgctcaaatcgcgcccgaacatggcgaattccgcctcactcgtcacccagatcgaagacgtcaagcgcgagagcttcggcatcgagctcagcgtaatccagaacatggtggaggccggcgacatcacgcgcgcgcaggcacgtcagctacgcaagaacgtgtatgtgatgagcgtggccgccgattcgaacttctgatctgccttccgatctgcactgcacggcacggttcgcggaagagtctgaatgcggcggcagtggttgcgaatcagatgatgccggaggcgatgtcctggtcgagcagccattggcgtaggtcggagaactcctccatgctcaccgcgtggtcgagcccgcggtagccgcgtgcggtgagccaggtgtgttcctcgagccatgcgatcgtctcgtagatcatgtatttcggcagcaccgtgtcgagttcaccgtacccgtagaacaccgggatattcagatcggcgagaatgtcgtcgtacggcgtggtcgccggcacgttgcccggagccacgaatccggagagggagatcgccgcacggtagcgttgcgggtgcacgcgcagcagttcgacggcgagcgtgccgccctgagagaagccgattggcaccacgtcgcggttctcgcccacgttcgtggtcacccagtcgtcgattgcgcaggcggcggcataggcgtcgtaatcgagatcgtcgcccaccggcaccgcgtcatggaaccagctgtacgcaccctgctgcatggcgaatccgcgtggcgacgcctcctgcagcacgagcggcgcccgcaatgatacgaagtcgctgtatggcgccacatagcgcattatgccggcgaggtcgtcctcattcgacccccagccatgcaggcagacgaacagtggtcggttcggttgcgcattgccgccgcctcgcgaggccaacgcctcggtcacggtaagccggtcgccgaaatgcccgggcaccaccgaggccacgcggcccaccggcggctccatgcgtttgcgttcgccggcgctctgccccgcgtacgggcccgacggcgtcgtattcgccgcctcggtcatttcacgctcgagattggcgaaatcgaccagatcgtcgagttcgcgagacagatcgtcgagatgctccggatcatcggagggctcgaacgggtcgtcgggattcggggtgtcatctgcagtgctcatgcgtctcaatatacgcgatagtcgcgcatacgttcatggcgttcactgtgcgccatttgccggggtgcccccgttgcccgtcgtctcaccgtcggtgccggtggcaccggcacccgtggtgccgtcgccggccgtgccggcatcggaagtgtcgggcgtggtggtctgcgcattctgctgctgcgcctgcgccgcattctgctgggcctgctgggccgcttgggcttgggcttcggcctgacgctgcgcctcctcggccgcctgctgggccgtcgcagcctgctggttcgcatactcggtctgcgactgctgcacggcggtgccggcatcggtgagcgtcttcaccatggccgtcacatcctccgcgttcagattctggccgtccgccagcttgcgcgcgtctgcgatgcggttctccagatcggtgcgaacctgctcgtcggtcacggcgttggcgcttgcgtcgagaatcttctgcgcgtcgtctatggccttcgtcaattcgtcgcgcgcggcggattgcgattgcatattcttcgaatcgttcaccgccttcgttgccgcgtcaagcgcgctcttggccttggtgatctcattcgcggtgttgcgcagcgaatccgtggtcttctcgatcgcagccgtgttggcatccaccgcgcattcggccaccgactgctggtcgagcttctcggcgtcggccacggcgctcttcagcgtgtcgagcgtcttcgcatcggcgacctgatcggtgggtgtgctcgtgagagcattggcgtccttcagcgccgccgcaagtgcggtatgggcatcgtcgtacgagtcgcgcgtgttctggcatagcgtgtatgcgttccgctgcgcgttgttcctgcggctgctcgaccaccatgcgatgccgccggcgatgagcgcgatcacgagcacgccgacgacaatgcccgcaatgagcttcgtgtggctcttgccgcccccgtttgccgaatgatgaggggcttcctcgtcgggctcgtcacccgatccatctgcattgccgtccgcatccgtcggcggaatggccggcggcatcgcggcgggggcggccggtggcatcaccgacgtctgcgaatctacaatctgctcccattccgaggagacgacgcgcgtcggctcttccgccggcaacgggggattgaccgagacgcccgccagcacatcgtcatggggcgacgtgaacagctgcgtgggcgcggcatcgcccgcagacgcgccgttcaccgtgttcgccgcatgacggccggcactgggctgggacgcggctagcgtgagcgccgcggaatccgcaggggtctcatccggcgtcggcgttgcatcatgtgcgcccgaacgcgcggtgcggcgcgcgtgatcatgcggatgcccgttcaccggcggtgcgggaatcgcagccgtattcgccgagcccgcagattgcagctgggattcgtgtgcggcggcatgcgacggatcgtcgtccatgctcgggaattcgagcgcatccttgtccactacatgggtgacatcgaaatcgcgcggctccggactcaccggaaactgcaaatcagacggattccccgaatcagtcatgcctctcctcgcccttctgtgtcaatctgtacatacattcaccgagacatcagtcggtgatctgcgcgcgatagaagttctggtacgagcgcgacggcgtcgggccgcgctgtccctggtaatgcgagccggtggtctcggagccgtaagggtgctccgacggcgagctcagctggaagaagcacatctggccaatcttcatgccaggccagagtttcacgggcagtgtcgagacattcgacagctcaagcgtgatatgcccctcgaaaccggggtcgatgaacccggcggttgaatgcgtgagaatgcccaagcggccgagcgagctcttgccctccaatcgtgcggcgagcgtctcgtcgatcttcacgtactcccaggtagaacccaatgcaaactcgccggggtgcagaatccacggttcgtccgggcccacttcgaactgttcggtgagctcgccctggttctccgctggatccacgtaggtatacgcatggttgttgaacaggcggaagaagcggtcgagacgaacgtcaatggacgctggctgcaccatttcgtcggtccacggatcaagcgagatatgaccctcggcgtgcgcggcacggatgtcgcggtcagatagcagcatcagcttctccttgcaaaggacgatgagtgttcctgcgcacgtcggacgcatgcatacgctgccatgcccctcgcacgcacatatacggcccagtgtagtgataccaagcgaattcaccggcggcatgaaccgccacgaccgcacacccggcccgggaaaaggcaggggcctgccacgacgggcaggcccctgcgggattccgagaggaatcagtgcgtcgcgcgcatgcgcaggaagatcttgcgaatctccgaggcgacgagcacgatggcggccaggccgatgcactccagccacgccatcggcggcagcggcgtggtgccgaatgcggtgttgagccacggcacgtagatcacgagcagctgcagcacaatcgacagcgcgatggcgccccacagccacttgttcgagaacagccccttgaaggcgctctgcaggtgcgagcgcgaggcaatcgcattgaacagctgggcgaacacgagaatcgtgaagcccatcgtgcgagcctcgaccatctgggcgtcgtggccgagcgcatccacggaacggtcggtgaacacgccgccgctcaggtgcatgtccatgccgatcagcgtcacgatggccatgatgaggccgatgtagacgatgtcgccccacatcgcaccgtcgatcacacggtcggtgagcttgcgcggcttgcggttcatcacgtcttcggtcgtcggatccacgcccatcgcgagcgccggggcggcgtcggtgagcaggttgatccacagcagctgggtggcgagcaacggcaccgtcacgcccacggaatccgggttcttgatgcccaggaagccggcgagcacgacgccgaggaacacggtgaacacctcgcccacattcgagctgagcaggtagcgcaggaacttgcgaatgttgtcgaaaatgccgcggccctcgcgcacggcggcgacgatagtggagaagttgtcgtcggccagaatcatcttggccgactgcttcgtcacctcggtgccggtgatgcccatggccacgccgatgtcggcggccttgaccgcaggcgcgtcgttcacgccgtcgccggtcatggcggcgatgttgccctggcgctgcaggctctcgacgatcttgagcttgtgttcgggggccacacgggcgtacacggagacctcggaggtcgccttgtcgagctgcttctcatccatcgaatcgagctcgtcgccggtgagcgccttgccgccctgttcgatgatgcccaggtcggaggcgatgcgggccgcggtgagcggatggtcgccggtgatcatgaccgtgcgcacacctgcgcggtgcgcttcggccacggcgtcgcgcacctccacgcgcggcgggtcgatgatgccaaccatgccggtccatacgagctggtgctcgatcacatctgcctgctccgagatgtcggagacgtctcccgcggcattcgtacgaatgcccggcacctcgctcagcgaagcggtctcgagcggtcggtaggcctcgccgagcgtgcggtaggcttcacgcgagagctcctccactttcttgagaatgtcctggcgatcgccttcggtgagcttgcgcaccgcgccattgacgaagatgcggtcgcagtagctcagcagcacgtccggggctcccttggcgaacacggtgagcttgcccgagtcggtgtcgttcttcgtgatgaccgacatgcgcttgcgctccgacgtgaacgggatctcggccacgcgggtgaagtggtggaatcgcttgtcggcgtgcgtcttgcgtgccgccacgacgagcgaaacttcggtcgggtcgccgacgatctcccaggttccaggcttggggccctcgcgcagttcgccgtcgttggccagcgtgccggcgccaagcgtggcgtagacctcctgcgcgatgttctccggcacggcatcgccgttcagcgacaccatatcgccttccggcgcatagccggtgccggtgagttcaacttcgccgctcggcacgaccacgcgttccaccgtcatctcgttgcgggtgagcgtaccggtcttgtcggagcagatgacggaggcggagcccaacgtctccaccgaatgcagcttcttcacgatggcatggtgtgcggccatgcgctgcacaccgagagccagcacgacggtgaggatggtcgccaggccttccggcacggcggcgacggcaagagaaacggcgagcagcagcgagtcgatgacgtcatgcacgctatggaagccttcgagcaccgcgagcgccaccagcaccaccacggcaatgatgcacacggcgatgccgagaatcttcgagacgtggttcatttccttctgcaacggcgtggtgtcgtcttcggtggactgcagcaggtcggcgatcttgcccacctgcgtgttcatgccggtgccggtcacgatggcacggccggtgccctgcgtcacggacgtgccgttgaacaccatgttcgagcggtcgcccagtgccttggccttctcaagcgtttccggcttcttgcccaccggcaccgattcgccggtgagtgacgcctcggcgatgcgcaggctggcggcggcgaacagacggccatcggccggcaccgtgtcgccttcgccgagcacgagcacgtcgcctggcacgatgtcggtggtggcgatacgctcgacgcggccgtttcgcagcacgttcgaggtcggtgccgtcatctcggacagcgcgttgaccgcctcgtcggccttcgcctcctgcacgtagccgagcacggcgttcacgatgaggatcagcacgatcactatggcatcgaagggcagcgcctcgccgccctcggcgccaggggccgcattcaccttctcgatgatccacgcgaccagcgaaatggccgtcgcggcaagcagcagatagaccagcgggtcctggaactgctgcaggaacttcttccacttcggcactggcggggcggatgccagctcgttcgcgccgaacttctcgagtcggcgtttggcctcttcgctgctcaggccggtgtgggtgtccacattgagggcctcggccacctcgtcggcgctggcgagcgacgggtcaacgtcatgcaggagcgcctcctgggccttcacttccttggattcttcggcatccgcaggttccacatggggttcgcggttcagtgcggatggatctatgatgcgatcatccataaataatctcctcggtcagccgcggagtagtcaaccatgctctgcctggcctgcaactgcctctgctcgcaacatctgcagagtctgcatacacaatctgcacagtattgcacagactgcaactgttgctgcacggtttgcagtgccggcacacgcctggctgcgcggttatgggcatacgctttgtcgcgcaatgctaacggttgccattattccacacaccacgacgcaagcctatgcctgtaagtgaatatcatgtgtggcccctggttttttcaccaattcttgacaacgggtgctgagagaatgagcgcatggctactaagaaaggcccgaccaaggggtcgggcggtaaacatcgtaattccctgcgcggcaagggccccaccccgaaggccgaggaccgcgtctaccataaggcatacaaggcgaagaagcaggccgagaaacgccagcgttccgatccgcgactagccgcacgccgtcgcgccgcacatttcacgtcgaactccgacgatctggtgatcggccgcaactcggtgctcgaggcattgcgtgtgggtgttcccgccagtgtgctgtacgtggcgaaccgcattgaacacgacgaccgcacgcgcgaaatcgtgcgtctggcaggtcagcatggtctgaacctgctggaagcggaccgtttggagatggatcgcatcgcacgttcgggcaatcaccagggcgtgatcctcaaggccgacccgttccagtactcgtcgctgcatgagctggtggaacgcgcggagcgcaaggcacgtgccatggagatggcggattccaaggcctcccgcctgagcgcacgcccattgttcattgccctcgacggcatcaccgacccacagaacctcggcgccgtgattcgttccgccgccgccttcggcgtcaacggcgtgattctgccggaacgccgctccgcctcagtgaacgccgccgcgtggaaggtctccgccggagccgccgcgcatatgccaatcgctcgcgtcgtgaacctcacaaaggcaatcgaggcgctcaaggaacgcggctactacagcatcggcctcgacggcggcggcagcaagctcgtgggcgagaccggcttcgaaaccgatccgctcgtcgtggtgctcggctccgagggcaagggcctgagcaggctcacccgcgaggcatgcgacgccattgcgagcattccgatcacaagcgccgtggagtcgctgaacgcctccgtggcggccggcatcgcactctacgccaccgtgaacgcacgtcgcaaggccggcgaagccgccaactgactctctgccgggcatcggtttcgtcatccgttcgggttttcgcgagtcaatgacgaaaccgatgcccatggttcgtcatatcaccgcaatctggcgaaccaatgaccaaatcggcaatcagagtggcgtacgtgctgccagccagctctcagtgcgcccatacggcggcatccgggtcgtcctcgggattgtacccgtcgtcgtggccggccgccggcgcagtgtgcgcgccgttgttcgaggcgtcgtcatacgtgtattcatcgtcgaccacaccggcatcggcatcggcgttcagctcgttcaccgtcttcgtgtcgagctggtactgcggcagcacgttcttgatgtagctttgcacggcctcggccatcggcacgtcgtggccggctttctcggccatgtaccagcggtggtcgagcacttcgtggaagaactgcgcgggctcgatctgcgaacggtattcgcgtgggatcatgcgcaccgtcggctcgaacacctcgcgcatccagtcggttgccacaatctcgagatcctcaccttcgcgccagctcgaggcacggtaggcgtcgaggtcgttgagcagtctgcgggcctggttctcctgcacgtcgaggccggtgaggcgcagcagtctgcggttcgcatagccggcatcgacgacgcgcgggcgcacgagcacacgcttgccgtcttcggcggtcttcatctcgagctcgtccacatcgaacccaagctcgttgagacgattcacgcgcttctcgatcttccacatctcgttcggcgagaagttgtcggtgtcggtgagcgcgctccacagcgaatggtagcggtcgacgagccggtttcctatggagatctcgtctacatccggcggcagcagctcgcccgagctcagatccatgagttcgccgatgatgttcgtacgggccagatcgatatcgtactcgcgttgcccggcggtcagttcgatctgcagatcgcccgtctcggcgtcgacgaggaatgcggagaatgcgtctgcatccttgaggaagagcacgttcgacagcgagacatcgccccagtagaagcccgcgaggtgcagacgcaccatgagcacggccaacgcgtcgatcaggcgttccgcggtgtcgggccgcaatgtgcgcgcgaacagggcgcggtatggcatggagaaacgcaggtgcttggtcaccaggatcgcctcgagcggctcgccgttgtcgtcatgcctgccggtgaccacggctatcggctgcacagtgggcagattcagcttctgcagctgccgcagcagctcgtactcgcgttcggccacggtgcgcgtgatctccttcatcgcgtacacctcgtcgcccacgtgcacgaagcgcacgatgtggcgggagatgcctcgcggcaggttcaccagcagttccggcggccaggtggcaagcggcttctcccacggcagcgtgaacatcttcgggtccgagctcgccgctgtgatctttaacgtcgatggcccggggcctggcgtcgcgggatcctcggccttcaccgacgtcgccttcaacgcgcgcggatccaattgcggattatcggttattcccatgccctacccatccttgtgccatacagtgcggtattcagatttcagattcctagattacccgcattccgcaccggacacccgaataatctgcagaaggaagagaatgcgcccgaatatgcgaaggaccccgtgtataacggggtccttcgcagatcatgtcaacgccctacctgtgcgcttccgcttgtttccacgtggatgcgccggctagttgagacgcagctcggtcgacggggagaagaggtgcatcttggccgggttgaccttgatcttgacgacgtcgccgaccttcgggagcacacgcggattcacacggatcgtggtgagctggttctggtcggacatcagcgtgtcagtggtcttctgggccacggaatcatcggtgatgatgttgccgtagatgtagccgtcggagccgagatcctcgacgttcacgaccttgagcgagaaggcgttcgcctcatccggggccgccagcgaggcgtcctccggacggaagccgacgatgatctcgttcttgtcttccggcgtgagcttgtcgagggcctccttcggcagttccatggtgtcggcgccgatctgggccttgccattgaccaccgggtgcgtgttgatgttcatcgacggggagccgatgaagcctgcgacgaacacgttggccgggcggtcgtacagctcggtcggggcaccgacctgctgcaggatgccgagcttgatgacggcgatgcggtcgcccatcgtcagggcctcggtctggtcgtgggtgacgtacagcgtggtgacgccgagctggcgctgcagtgccgcgatctgcgtacgggtctgcacacggagctttgcatcgaggttggagagaggctcatccatgaggaagaccttcggctcgcgaacgattgcacggcccatggcgacgcgctggcgctggccaccggagagagccttcggcttgcggtcgaggaactcggtgagatcgaggatctcggcggccttctcaacgcgcttgcgaatctcgtccttcggggtgccggcgatcttcagggcgaagcccatgttgtcggcgacggtcatgtgcgggtacagcgcgtagttctggaacaccattgcgatgtcgcggtccttcggctgcatcgtggtgacgtccttgccaccgatcaggatgcggcccttgttcacctcttcgaggcctgcgagcatgcgcagggtcgtggacttgccgcagccggaaggtccgacgagaacgaggaactcgccgtccttgatatcaagattgaggtcatccaccgacggcttgtcgttgcccgggtagatacgagtgacatgatcgaaaatgacttctgccatgtgctgttcatcctttcatcggcaggtacgtgccgaacgatccgttgtgaggggattactgtgttgtgttgtttccgtttgcaaccgtcgtcttcgactaggccacaaccttccaccgctccgtgaagtgtttctcttcgatgagctttcttcactatacacaatccggcgaacaaagcaaatccctccgccccgcgcaccgtcgcgtgcatatgcacaagcttccccgcttgcccgaactggtaggttcgtgatagccatcatgccaaatttgccgtgcgacacgcaagcatgcccacagaacgggcacattggcgtccatgtcacgcgcggaatcgatcgtccgagagtggattcgcggattgtcttgatcttggcgcccatgtcacgcgcggaatcgatatcgataatagaatcggcactatgacggcaagaaaaagcgcacgacggcccggtctgacactgcacacctggcagcattacaccaacgcgcccatgttcgtgctctccgcgttcttcctgttcgcgtactcgtggcagattctcgcaggcacccacacacggctgtgcaatctggtgatcaacctggtctgggtgctctacagcatcgactacgccatctcgctgtacctcgcgcccaaccggtggagctggttcaaaagcaacctgatactgctcatcacgatgatcctgccgatgttccagccgctgcggctgctgcggttcgtgccgatgctgcacatgttcaaccgctcggccggcacggcctcgcgcgggcgcatctcgctgtacgcggtcgccgtggtcgcgatgctcatctatgtgggcgcgctcgccgaatactcggtggagcacaaggctcccggcgccacgattaccagtttcccgctgtcgatctggtgggcgtttgtcacggtgaccacggtcggctacggcgacgtctacccggtcaccacactgggaagattcatcgcgatcattctcatgatcaccggcatcgccgtcatcggcatcgtgagtgccatgatctcgtcgtgggtgatcgaccaggtcaatgtgcgcccgcatccggtgatcccggcgccggcagtgggcgaggacggaggcgcatccccgtccgcgaacgcctccacgcacgacgcagggggttgccccgatgaggattacacgacgggcgacgaggacatcatcgacgcgccggacccgctcaacggttcctccctcggcccgagtctgaacccggcgcaatccagaatcgtgcaggcggaactgctgcggctcaccgattcggtgaatcgtctgcacaacgagatcgaacagctgcgtcgcgcggaacacaggcacatgcaagcctcggggcagaccgcgcgcaaattgagatggcacgcgaaccgcaacgggcatatgcctccccacgactcccccgaaggcgacaaaccggcatagtcgcgacgcgcccacccgcttttcgcacatttgttcgcatcgcgagtgcgttcgctatacgataggcgtatgactgatgtatacgcattgcaattgcagcccggagacgtggtgggcggctacacgctcgagtcacgccttggttccggtgccatgggttccgtatggcgcgccgttgacggcggaggcaatgcgtatgcgatgaagatccttcgggcgtcgctctccgattccgacgacggcaatccggattcgcccgaataccgcgcgcagatggtcgcccgtgagcgcttgcgccgtgaggccgtggctatgcgcaagatccgcaattcgggagtctgccagattgtcgacatggagatagacgattcgctggcattcctggtgaccgaactcatcgagggcgaaaatctgcgtgaggatgttcgccataacggcaagtatgtgggagacgatctcgaacggctctccagcaagctcatcgacgccgtgcatgcagtgcatgaggcgggaattgtgcaccgcgacatcaagccgaccaatgtgatgatctcggtgacgggtcctgtgctcgtggatttcggcatcgcgatgacgccgggcgaaagccatgtgaccagcaccgggctcgtgatgggcacacccggcttcattgcccccgaggtcatcgagggcgccgaatccacggcggccagcgattggtggtcgttggcctcggtgctcgcattcgcggcgaccggcgaaccggtgttcggcacatcgcccatgatggcggtgctgcaacgcgaggcatccggtcacgcgaatctggcagggctgcccccgcacacactggaggcgttccgcgccgcattggaccccgacccggcccaacgctgcaccccacaggaactgttggaggccattcgaaccgacgcgtggaccagtgacggcgaggcgatgctcccttttgaccttcgccgcatagggcgcagggaaaccgatgcgcccggggtgtcaggcagcgtgctcagtacccatgagcgtgtggagaacccacgcacgttatggcaccgccagtcgttgcccaccgaggccatgccggtgaatgcctccacaggtacggtgcccctcccccctatggcccaggcatcgcatgcggcaaacgacaatggcgatatcgtcacaccttccttcaatgacgccgagagcacaggcggcacaagggttttaccccaacagagctttccccggaagtgggactccgagcatacggcgacgatgccccggccgcaaccgaccaccccacttgcggccacaccacccctcgaagcggcgactcagtccatgcgccccatgcaatccgcaaccgggttccaacccgtcggccctgaggcaaacaacgcaggggcctccccaaatctcgaccagccccaatatgatgcgcccaatggcgcttatgccccgcaggcacctgccttgcccagtgattacggaccggtcgcgactgcgtaccagaacaccgtgcgcatgcaccgcacccgcgggattctccccgtgctgctcgccacactgccgttgatggccttggccgccgcctgccccatgggcgcaggcatcgccgccagcatgctgatctgggtggagctcacgttgggcatgaacctcaacacacatgtggcccatgtgctcaggcgcaatgggcaggagggcagcgggtccaaggtgttgcgtgtggcccagctgccgtggcatgcctttgcggcgttgttcatgtcgctctggagtctgttgctgttctgggcgatctatgtggcgctaatgctcgccgccatctatctcgtgcggctaccgggcgcctactacacgctgccacctgagccgccctggagccggctcgactccgtgctgctgctcgccggctcccccaccggcatcaacggcctatggctcgccatatcggccgccattgcatgggccgtcacgcaattcggcccgtattccgcgaatctgcgcgcgggtgcgggcgtgattgtaggcctgagccccaaacagcggctcgccttgcgccctgacggcaaccatcggaacatccgccgtttcatcgtcctcggcatatgggtgatcatgctcgcgctcaccatcttcaatctggaagccacgccaagcatcgattggtggcccattctgccgtggtccggcttctagagccggcaaggcgggaggccgggcccagtcctcactgcaccagtcattcatcagtcatccccaaatgggaagaaaatatgcagcgcaggtttttcttcccgtgaaagacctcctatctgcgaagaaaaatcgatcccgcatattttcttcccgcgaagaggcatctaactgggaagaaaatacgcggtcccaatttttcttcccatgaacaccgcatatcaggcagacgggcctcgcgaagcgcatcagtgaagccgccgtaccgagacgccctgacgaggcgagacccaagctcaccctcccccgaatgccgcagctgcacgcgattgccaaagcatgggcgttgccatagactgcttagggtaaggaaaggacgggcatggccgcaaattcgaagcaaccgaaacgggaaagccgggctcaacgccggcaggaggagcaggcacgcgtacaagccaagcgcgagcgactgcagaaggaacgcagaacacagacgatcatcggcatcgtggtcaccgtggtgctcatcgcactcatcgccatcgccggcatcgccgtctatcgcaacacgcacccgagtgccgccaggcagcaggaggcggcgaacgagcaatccgcagcgcaggccacgctcaaggactccaaggtgaagccggcgaaggccagcgagctcggaggcctgctcatgtcgaagaacggctataacaagccggtggagggcgtgcccaccgtgggaatctacatggacttcatgtgccccggctgcggcaatctcaaccgcaacctcgaccaggacctcgtgaagatgatggatgcgggccagatcaacatcgatctgcacatcatgagcttcatggaccgttactcgtggatcaacggcgattcgaacaatgtcgacgattactcgagccgcaccgccaatgcggcaatctacgtggccgagcacgatgacgacccgaatcatctgctcaacttcatcacgaacctctacgccaaggacttccaacccgaagagggttccgggtacaaacaggtgaccgacgaccagattaaggtccgcatggatggcaccggcatctccaaggatgtgcagggcaaggcgatgcagcgcggctacgacaagtggctcgatgccgtgaacacctacacccccacccgttccgagctgttcaaccgctccggacagctcaagggttcgatgagcaccccgacgatgacgatcaacggctactactgggatatgaacagcagcgaggtcacaagccacaagacgctcgccgaggcgttcctcgaggcaatcggcctggcccagaacaaggtgggtgatgccgaggtgcgtccgtcgattggcgcgaccggcaagccgctcatcggctatgccgacgacaacgccggggctgccacgaactcacagtgacccacccggcgatagcggggccacgaaatctgcagctagacacgcgcgtacaccatgccctcgcctcatgtgaggtatactctgtgacggccgtggatatattccacataccgagccgagattgtgaaagctctgtgtgacacgcgcgtggccggtttgccagcgattccgggcatctgctatgctcagctgttgacgtcgagcgcacgttgcgcctccttagctcagatggccagagcggccgccttgtaagcggcaggtcgtcggttcgatcccgacaggaggctccacggttgtgtctggggagtgtatcgcgtacaatgaaggtacatttcctttgaattgataattgaataacacttaccacgagtaagatccagaagtcttccccccaaccatgagacttctggactgagcagcgaccctcccctagcggtcgcgctcaacgggggcgagataacccccttctctctcgccccctattacctcaatggcttcagcgtttcggcgctgaagccatttctttattcacgttcactgtctatgcagaaggtgagttgctgtcggtacaatcgatagcgcatattcacaagcacctgctcgacgaccacgcctgcggcgcaagatgcaggggctctgttgcaacggaaaacgggaaagaggaaccatggcgagacgttggactccgcagcgcatgatgcgattgcggaccattcgcattgcgtcgagtatggtcaccattgtggccctgctgctcggtttcttcgtgtgcacacgaaaaaccgtggcgctcgaggtgaacggcaaaaccaccaccgtcaccacgttcgcgaccacgattcccgggtttctgcgcgaacagcatgtcaagctcaagactcacgatctggtgcgttcatccactccgggccagctcaccgacaactccaccgtcaccgtgcagagcgcctaccagacgaccatctcaatcgacggccagcagatgccgttctggacggtcgccgacagcgcggaacagctcatcgccttcttcgaacagaacgaagtggccgcgaaccgcatcaccgtggacatcaagaacgtgtataaccagctcaccggcggactggtgatcaacgccgacggtccggtcaccgtgatcgcggacggcaagaccttcattgcccccaacggcaagctccccgccgcctccatactcgattcgaaaggcatcacgctgggcaagaacgaccgcgtgagcgtttcgaaagacggctcgcagaccattctgcgcgtggagcgcgtgaccaccaaggagatcaccgaaaccgaggatgttccgttctccacgcagacgattgtggacgactcgcttgaacccggggccactgaggtacggcaggagggcaggaacgggcagaatcagctgcgctaccgcgtgacctacgtggacggcaaggaggactcccgcgaactgttggacaccaccccactgtccaccccaatcgaccggatcatcgccatagggcctgaacccgtgaaagagacgccccagaaggaagacaactccggcgcgtccaacgacgaagggcaatccgcagaccaatctgcaggcaattccgcgggtacgaacgacaagcagtccgcaacggaaaacaacaccggagacgccgcggaaccaagtgctgaatcctcccccaccccctcggcacaaccgagccagcagcccggcgcgaagccgagcgagcaaccgacgagcaagccgacgcaatccgcacagcccacacagaaaccgtctgagcagcctactcagcaaccgtccgcgcagcccacccaacagccgaagcccacgccgacacctacccaaaagccgacgcagcaaccggaacagcccacgccatcgaattgccgcctgtgcaagccgagtccgagcgccgcgcaagcgtatgcggccggcgccgcggcacaatacgggtggaccggcaagaactgggaagatctggtgaagctgtggaaccgcgaatcaagctggctgtggtatgcggagaataagtcgtcgggcgcatacggcataccgcaatccctgccgggcagcaaaatggcacagttcggcgagaactggaaagaagacgccgccgtgcagatcgactgggggctcaactacatcgccacgcatccgaagtacggcagtccgagcaaggcgtgggcccactccgagaaatacgggtggtattaaggagcgccacatgttggcacgcatccggtctgcccgacagtggtgcggccgcgcatgcagcagatgaggacgcctacacttggtattgagcatttgacggacaggatcacacaaagatcacacaaggattcgggagcaagcatgggcacagcgcaagcagacggcgggaacctgctgggagcggccgatattcgcagaatcgccgccgaagagggcatcacgccgacgaagaagttcgggcagaacttcgtgatcgaccccggcaccgtgcgtaagattgtgcgcgaggcgggcgtcgacgccggtgaccaggtgatggaggtgggtcccgggctcggttcgctcaccttggcgattctcgagaccggcgccgacctcaccgccgtggagatcgatccgccgttggcacagcgcctgccgcagacgatcgccgagttcatgccgaatgcgaccaacagattccgtgtggtcaacatggatgcgctcaaggtcacgccgtcgcagttgccgcagctcgccgacgccgcgacgttcacgctggtggccaatctgccctacaatgtggcgacgccgattctgctcacgctgctcgaacgattcggcaatctcgactccttcctcgtgatggtgcagaaagaggtggccgaacgcctcagcgcacagccgggatccaaggtctacggcacgccgagcgtgaagctcgcctggtacggcaccgcgaaaagcgtgggcaatattggccgcaacgtgttctggccagcgccgaacgttgattccgcactggtgcggttcgaacgccatgccgcagacgacccgcgcaatcccaacaaccgcagtgtggggcgcgatctggtgttccggctcatcgacgcctccttcgcgcagcgacgcaagacactgcacgcggcattgaggaaaatcgtgccctccggcgcattcgaacgcgcgggaatagacccgactcgccgtggcgagacgctcgacatagacgaattcgtggcgctcgccaccgcatgcaaggagcttgaagcatgagcgcacccaacggcgcccgattccagacccccacgctccgcgcagactacgccagcgtgcatgtggactgccctgccaagacgaatctcacattgcatgtgggggaacgccgtgaggaatggggcggcagacatgccttggagaccatctactgcggcgtgggtatctacgacacggtgacggtgaccgccaaggaaccgggcaccggcttctccctcgatctcgccggcactcatttgggagatctggccgcgtcgacgagcgatatgcgcaggaaccacgccgtgcttgccatgttcgcgatggcgcaggccagcgggcacgaacctgacgtctccattagcatagagaagcgcattcccgtcgcagccggtctgggaggcgggtcggcggatgcggcgggcacactgctcgcgctcaatgcgttgtggaatctcaattggccggtggcacgactccgcgagatagcggccgccttgggcgccgacatgccgttctgcgtcaccggcggcctggcgttgggcaccggcttcggcgagcgtataaaggatctgaccgcatccgacccgcgtatcgaacatgcggtgggcgatctgttcgcagatgccccttccggcgatggcgtgcacatgctcgtcggcgcatacctgtcgcagctgagcacgccagaagtctactccaccttcgacgtgctcggcgcaggagaaggcgacctcaacgagttgcagcacgccgccgtctcgctgcatccgcgcagcggcgtggccatccgcgaagctcagcaggcgggcgcgacgagtgccttcgtctccggatctggccctactgtaatcgccgtggtgcctgacgaccgggtgcgcgaggcgacgcgcgcggcatggcaggcttccggggccgtcgaccgcatcatcgatgcacaggcaccggccgcaccgctcatgcgagccgagtagcgggcagccggaccgccgggcgtcagggcttatgcgatactggaaccaccggttacatgtaaaggatggacatggcagagaataatgacgcccgcgaagaacgccgggagtatgtgcacaggcgccagacgatcgtgttcgcggtcgtgggcgcggttctcgtggtcgcgctgttcatttcgtcgctgttcctgttccacgtcggtggtctgggcgaggtgaagaccactgccgaaggggcggaccacggtgtggtggcgccctgcgtatcccctgccgaagatggcagcaaaccgaagtacctcgacagcaaatccgtgaccacgcgcgtgctcaatggcacgaagttctccgggttcgcgaatgccgtcggccgggcgctgcaaaaccgcgaattcgtggtgcagagcattgacaactacgacaatgcgaaggtggagcgcaccaccatcgtgttcggcaagaacgccattccacaggcgtacacgcttgccgcgaacttcccggacgcccagctgcagatggatgatcggcaagacaaactggtggacgtgattctgggcgccacgttccagaacctcacgaaaaccgatgaactgcccaagaccggctccgagatcccgaacatcgagggctgcaagccggcgaacgacatgaaagaccttcccaaggccccggaacacacttccgtgggatgacattagccctccggcatgattgtggccggggtgggacctcgcttcgtcaaacgctcgctacggcggcttcgacgaagcgggggcgtcggccggggcccgcacacggcacaccggcattcccacagcgcgctactcggcttgcgaggcataccagttgtggagctcggccacagcggtgtcgtgatcgacggggccgttgtcgagacgatattcaagcatgtgtcggtacgccttgcccaccaacggtccgggagcgatgccgagttcggccatgatctcgtcgccgttgagatcggggcggatcgcatcgatgtcctcctgctccttgagcttggcgacgcgttcctccatctcatccatcgcatgctcgaacatgagcgccttgcgtcggttctgcgtggtggcatcggcacgcgtcagccgattgagacgggcgtagagcgggcccgcgtccttgacgtagcggcgcacggcggcatcggtccacggttcgtccacgtagccgtggaagcgcaggtgaaggtcgaccaagtcgctcacctgctccaccacatggtggtcgaagcgcagcgccttgagccgtttgcgcgtcatcttggcacccaccgcatcgtggtggtggaagctcaccttgcctcccggctcgaatctgcgggtcttcggcttgccaatgtcatgcatcagggccgccaagcgcagcaccaggtccggggcgggcaccgggccatccgggccggtctccaatgccaccgcgcggtcgactacgatcatcgtgtggtcgaacacatccttgtggcggtgatgttcgtcaatctccaagcgcagagcgggaatctcgggcaatacgacatcggcaagacccgaatccaccaatgcctcaatgccggcacgcgggcggtcggagagcagcagcttcgtcagctcgtcacgcacacgttccgcggagacgatctcaatgcggtcggtcatgcgcgtgatcgcctcggcggtctcgggttcaatcgagaagccgagctgcgcaacgaagcgaaccgctcgcatcatgcgcaacgggtcatcgtcgaagctctgatatgggtccaccggcgtgcgcagcacccgcttgttgaggtcgttcgccccgccgaacgggtctacgaattcaaggtcgggcacagtgagcgccattgcattcaccgtgaaatcacggcgggagagatctccttcgagcgaatcgccgtagctcacctccggcttgcgcgaatccgggtcgtacacgtcggagcggtaggtggtcacctccaccttgacctcggtgccatccggccgtcggcgcatcgcaccgagtgtgccgaacttacggcccatgtcccagaagccatcgtgtccaaagcgccgcagaatcggctcgaactgctccgggcgcgcattcgagcagaaatcgaggtcatgcgagcgccggtgcagcagcaggtcacgcaccgggccgcccaccagcgccagttcaaagccttcatctgcgaacatctgccccagctcaatcgcttcaggccacacctcgaagttcacgccgcacctttcatttgcgcccgcccatgcgaaacgcccaatctgcaatacaagaacctgacgagtgcgcaagagcggcgaaacgcccataacgccacggctgcatgccttggccgcagcacccgtcattccgccatcaagcataccgatacccatatgcacatttattgagtatggttggaaccatgatcactcccgcagacgttgctcgcatgcatgccaacgctgcggtgaaccatgccctgagccccgacgacccggatttcgacccgctggtgccggacgaactcatgtacacatcgcagaccaccacggtgcatctgaacacggtgctcgatgaggccagggcagtcaaggcgaaactcggggcggaacggatcgaatcggcttccacacaagcggcacatatgccgacgccggcggatatgccgtcgcacccgacctcccacgaagccgcgcaggaacaatccggcccctcggaagacactgtgccgaatcaagcgcgcggcacacgtcgtataccgactccggcacaggtggcgcaggccgcccatgcagcacgcatgatgcaggcattgcacgctacgcaacccctgtacagctcgcagcccgtgccggcgcagagcacagcggttccggcgcaccccatgcgcaacgcggcacggcgtgacccaggcaaaccgaccccggcaatgatgccgcagcggcgcagcaccgaccgccgcagctcgttcgcctcgctcgacgcccaggaactgccggtggtccgcgaatactccgccggtgggctcgtgttcgacgcgcatggccgcgtggcgatcatcgcccggcattcgcgcagcggacatcttgaatggtgcctgccgaagggccatatagagaagggcgagacgccccagcagaccgccgtgcgcgagattcacgaagagactggcatcattggcgaggtggtagattccatagccacgatagactattggtttaccggaacaagtcaacgcgtccacaagctggtgcatcatttcgcattacggcagacgggcggcgagctcaccgttgaaggagaccccgatcacgaggccgaagacgccatatgggtggatttcgcagacctcgacgatgtgctcagctaccccaatgagcgtaagattgcatggctgtacgcaaggaaactgaataggcaggcttaaacgtgaatccacaccgcaccgacctgcgccacacggcacgacagcggtgcaagggcactgcgctgctcacggtgctgttcacgctcatactggcattgtgcaccggcttcgcagtgcgcccggcacatgccgaggagcccgacgccacgacgaataccgaccaagccgccaaacccggcgtctcgatcacggtcaactcgatgacgccggtgatcacgccatcctccggctacaaactgaatctgaccgtcacgaacaacaccgacgcggatgtggaccacggctccatagacgcactcacgaacttcacctacaatttcatctcccgcaccgacctgcaggaatgggccgaaggccgagggcagattccgctgcccgacctgcttgtcaccctgcatgtgccgcgcatcgccgcacacaaatcggtgaccgtgaacagttcgctgcctgcgagcgaggagattctcaaacagttcaattcgtggggtccgcgcccgctcgcactcgactaccgcagcgatgacggcgcgcagacgagcacgctgcacagtttcgtcacgcgctcgcaggacggcttgcaaggcgagcgcacaccgcagctccatatgacgatgctgatgccgctcacagccggcgactggtcgctcgacgagaccacactcaaggcgctgcgggcggatcgctcggcgaagacgcatgcctccgccatcgcgaccttggacggcaagagcgccgaggcgctgcgcaccaaggatcagctcacgcagcgcttcccccatgtgcaggcgctcgcggatccgcaggtgctcgccacactgcaggcccctcacatgcaggcgctcatgcaacccgccgatttcgacatcacccgctacagctatgccgacaatgcgaacggatatgagaatgcgggcgtcccgttgtcgagctgggccgcctccagctcggtgcagacgctgcgcaccgtgctcaacgacggcgctgccgaacgccccgtctatgcgatgcagggtgtgggtgcctggaacaccgaggctctcgatacggcacgcatgcaagggtatgacacggtgattgccacccatgacttcgatgatcaggatgacaccgccgcgcacaccggcgtctatcgcgtgcccaccgcccacggcgacgtcacggtgatggccacgcatcccatgctctcgcagctggcggcgggccaagccacgtcgcaggaggcacaggcggagacgaacaccgccggccggctgcagaggttcatcgcgcagagcgccttctaccaaatggaacagccgtaccagaaccgttgcctgctggtgagtttcggcccggattcctctgccgcgaacatcgccgccttcatgggggcgctgcaggaggcgagttggctcgatctcaccgatctggagacgctccgtgccagcgagccgtacatgagcggcgatgatgcggcaaccgtggccgacaccaccaccgtcgacccggctgcgtatgacacaacaacgctcgacacgaccttgaccacactggcgcacacacgccgtgacctccagcacttcaacacctccgtgctgctcgccgatggcagcatgccgggcgggcccgcggcacagacgggcgatgccaacaacaccaagcccggcgacggtgatgccaacgatgccgacgatgccagcgacaatgccacgtcagacacttccggtgatgcgctgggcgccctgcaatggagcaaccgctggctgcaggcccacgacgagctcgcgctgctgtcgctcaatgcgaacaccgcacgttccagcgcgctcacggccgccacacaggccatggtcgactatctgcgccaaggcatcggactgactacccccaccaatgtgaacgtcgtctccgaatctgcctcgctgccggtgaccgtgacgaacagcctaccctacccgatctcattgcgcatctcgtcgcgtaccgattcaatggagatcgtcacctcccgttttgtcgacgtgaatgtaccgccgggcagcgaagcgcaggccacgctggagattcgcgtctccaccgcgggcaccacggtggccaatcaggagctcgtgaatcatgaaggcgtgccgctcagcggcatccacaccaccacgatcacctcgtcgctgcagatcagcgacaaaagcggcatcgtgttcatcatcatcgcggtgctgctgggcattgtaggtctgtggcgccaattccatcgcaagaaggaccccgacgaatgagctcttccataggacgcaattcgctcatcatggcctcgggcacggccgcgagccgcatcaccggccagattcgcacgattctgctggcggccgccataggcaccaccggtatggcagccaatgcctaccaagccggctcgatgattccgcaggtgatcttcacgctcgtctccggcggcgtcttcaatgccgtgctggtgccgcacatcacgcgtacgctcaacagcgacaacgcccaggagacgctcgacaagatcgtcaccttcgcgctgacgctgctgctcggcgccaccgtgatcatcgccgcgctcacccccgtgctcacccgcatctacgtgaacggcagcccggatctcgtgggattgtcgatggcattcatgctgtggtgcaccccgcagattttcttctatggcctgcatatgctcctcgggcagattctcgccgtgaagaaccgattcggcgcctacgcgtggagttccgtgggggcgaatgtgattagctgcctcggcttcggcgtgttcattgcgatgttcggcaatgcggcgcagcagccgatcgggttctggactcccgccacccttgcgctcaccgccggcacctggacgcttggcgtggcattccaaggcctggtgctgctgattccgctcaaacggcttggcttccacttccacctgcgcttcggcgtgcgtggcattggcttgcggtccatgggcccggtggccggctggagcctgggcatcgtgggcattgaccaggtggtcaatgtgatcaccacacgcattctcaccagcgcgccgtcgatcgccgaacgcaccctgcatatgaaccagttcgacgtggccggcaacgccacctaccagaacgcctacacgctctacatactcccttactcgctcatcgccacctccgtggccactgcattgttcccgcagatttcccaggccatcgccaccaaggacctcgacggcgcccgcacagacctgtcgagcgcgcttcgcaccgtcggcgtcatcatgtgcttcttctcgtcggcattcattgtgatgccgctggccatcacgcgttcgctgctgcccacggtgggtgtctcgcaggcgttgctcatctgcggtccgctcgtgggcatgagcatctgcctgccgctggcgagtgcctacctgctcatccagcgcacattctatgcgttcgaagacggtcgctcgccgttcatgttcatggcgctcatgtatgcgctgcagctcgtgctcattttcatcggcaccagggtgttccctgccacggattgggcgacgatggtgggcctgtgcatgtcgctggcgtacgtgctgtcgttcactccgctcgtcgtgatgcttcgcaagcgtttcaacggacagctcgacggccgccgcatcgccgtcacgtacggcaaggcgttgctcgccgccgcggtcacaatcatcatcggtatggcactgcgcaaccccgtctactcactcgcgcaggtgctcaaacccagactcggcgtcaccggctggattctcaccgtgctggccactggtgtgctcgccgtggtgctgctcgtcatctatgtcgccgtgctctgggtgttgaggtgcgcggagctcatgggcatcatcgccacgctcaagacacgcttcgggcgcaagagcgcggccccgcaatccgagccgtccacggctgccggggaatccgccggcaccgcgccggcagtcggccgcagaatatctgcaagcacggcacgacctgtggagatgccgccgagcttcccgcccagtttctctcccagcatccccccgagcatgccgccgagcttcccgccgagcatgtccaccgacctgcctgccgaaccctatggtcagatcgaacagcttggcgtggtcgagccaatcgagttggccgaaaaccccgttgcgctgcaagataatcagtctgagggattatcgcggccgaccagtggcaacagtagaatcgaatcagcttataggagagcgcaaagcacagatggggagcatatgaggccgcacttaggagacaccgttctcaaccggtacacattggtatcaccacttcgcgaggagccgggactgcaggcctggaaggcgaacgaccgcgtgctctcgcgcgactgccagctcttcattgtgaacaacaaggccgtgctcaagaacacgaacgccgtcgccggcacgctcgccgccaccaaggatccacggttcaccccggtgctgcagctgctccacgacgggccggtcgccgtcgtgctcacgcaactcgacgcgggtgtctcgctcaccgaatacctgcagcgtcccgattcctccccgctcagctacgaggccatgcgcaccgtgatcggcgagaccggcaaggcgctcgcctcgctgcagcgcgatcatctcacgcatcacgcggtctccaccgacaccgtgcgcatcaccgtgggcggcatccagctcgccgacgcgtcgatcagcaccgcgctggccgacacctcgggagcctcgcccgccgacaacgacgagcgtctcgccgtgcgtcagctcgccagtgtgctctacggcatgctcacgcgccggccgtccaccttcccgccgaagttcaatctcaacgatctgcctgcagatgtgccaatggaactgttcgtgatctgcaagcgtggtctcgaactgcaggacggcaccacgccgacgattccgctgctcacgctcaatgagctcgaagcactgctcggcccatacaagccactgcacatgctcacccggcacgatctgcgcatcccgaacgcggagggcgcctgctccgtggtctatgcgccggtgcgcccgattctgcccagcgatctgctcgaactgccggattccctgatctcctcgcagacgcttccctcgctcacgttcgcctccactgcaggccccgaattcgccgccgtggaagtggatgacgaagacgagacccccggcgagaagacggaatccatgccggcgaactcgttcaaggcgctctggaacaagagcaaggcctacatggagggcggagaggacgcggcaagcgccatcccggagatctcgccggccgacgccaccgagatgttctcggccttcgacccgaacgcgcagaacgaaccgcctatgcaaccctcgcgcatgaccgtgccggtggatgtctccggcgtgcgtgacgggtctatggatgcaacgcgcggcgtcaccaccacggggcgcatcccgctcatcgacgaccaaggtaacgaagtgccgaacggcaccgaatcgcagcgtgcactcgaggaggagcggaaggcaatcgacgccgcgtatgcagccggcacgccggcgctgccgccgagcttcgcaccgcagagcaatccgggcgcgaacaccaatccgccgcgcgccttcaccaccaccggcgaggagaagaagcgcagcaagggtgccacggcggccgtcatcgtcgtgatcgtggctctcgtcgccgtgctgggtgtggcgatccacagtctggcaactggcggcacgctgttcggcttcggcaagcagaacaccaattactggccgagcgacgccgacatcgagaaggtgccgttcggcacccgctccggcgaagatgtgcagaacaagtcgaaggagccgtccgaagaggtcaagcccaccccgacacccacggagacgaagaagcccgagaacaccacggcctacccggtcgcctcgcagcgcttcctcgaccgcccaggtggccagcagggctacggctattacattcacctcgacaagaaggaggacgtctccaagatcgtcatcaagatccagtcctctggcggcaagggctacattcgcgtgaacacgaacggcgacccgaacgccggcgagcaggtggccgagttcacgttcgccgaaggcggcaccaccgaggtcaagctcgacaaatcggtgaacacgcaagacatcgtgatgtgggtgcccatcgattcactgcccggcaaccagctgtacatcaactcgatgcaggcgttctagcacgcggtcttgcggcctcagggaaacaatttcgcgggggtgtggtttttgccacacccccgccggcatctttcaatcgttacgggatgtcaagggcgaaatcgcaactgtggaaaacagccatatgtgcatgagaatatgcgggaatggacgaaatctgacatcccgtaagccacaacgacatcccgtaaggcataacgcgggaggaataatccaaaacccgcgcctattgtgggagtcatgaacagcacagcaacagtacataacgtcatcattgtcggatcgggccccgccggctatacggccgcgatctatctggcccgtgcaggtctcaagcccgtcgtcgtcgcaggggcgctcaccccgggcggccagctcatcaacaccacggaggtcgagaactaccccggcttccccgacggcgtgatgggccccgacctcatggaaagcatgcagcggcaggccgaacgcttcggcgccgagatcgtgttcgacgacgtggaatcggcggatctgcagggcgaactcaaatccgtgcatttgagcggcggccaggatctccagacgcgcacggtcattgtggccaccggatcgaattaccggcatctcaacgtgcctggcgaactcgaatattccggcaagggagtctcgtattgtgcgacgtgcgacggcttcttcttccgcggcaagccgattgtcgtggtgggcggcggcgactccgcgatggaggaggcgaacttcctcgcacgcttcggctcgtcggtcacgctgatccaccgtcgcgacgagttccgcgcctcccagatcatggtcgagcgcacacgcgagaatccgaagatcaacctgctcatgaacaccgtcgtcgaacgcatcaacggcgacggcaagggagtcacgtcgctcgatctgcgcaacacggcgaccaacgagacctcgaagatcgaggcgaacggcgtgttcgtggcgattggccatgtgccacagaccggtttcctcggaggccagctcgatctcgacgaccatggctatatccggatcgacgaaacctccaccggcgccacccgcacgagcgttccgggcgtattcgcggccggagactgcgcggacgccatctaccagcaggccattgtcgccgccggatcgggctgccgcgccgcccttgacgtccaaagctacctggaagacattcccgagggcatctaaaatgctggcttaacttgccgcaaagttgaaaagacaactctggagtgggaatctggtcgttccgacaattggatatgtgagaacgaccagattcccacggcccgccgggttacccaagcagatcgatgatgcgctgcatctcctcgggagatgagaacacaatctcaatgcggccatgctgttcggagcccttgatcgagaccttggtggcgaaccgttccgaaaggtgctgctgaatcggagaaccggcccacgggttgttgcggttcgtcttcggcttgcgcgtctccttgttcgcgctcatcgagacgatctcctcgacactgcgcactgagagaccctcgtctatgatgcgctgggcgagctgctccatctcctcatcggtgtcgagaccgagcagggcgcgcgcatggccgctcgacagctgccccgccgcgaccttcttctgcacgcttgccggcagattcataaggcggagtgtgttcgcaatctgcgggcgcgatttcgagacggactgtgcgagctgcttctgtgtcagcccgaactcgtcgatcatctgctggtatgcggcagcctcttcgagcggattcagcgcgaccctgtgcagattctcgagcagtgcgtcacgcagcatatactcgtcggacgtcgtcttcacaatgaccggaatctcggtgagtcccgccaactgcgacgcacgccagcgccgctcgcccatgatgagctcgtattcgctgtccatgcgcccggcgaaacggtctgcggcatgctcctcggattgcctgcgcttcgcctcgtcaatctgctcctgcgggcgtttgcgcacgacaatcggctgcagcacgcccacttccttgatcgagtcggcgagctcctgcagttcctcctcgttgaacgtggtgcgcggctggtacagattcggtccgatctgattcggattgagctccaccagatagcccccggcgaccggcttgagctcaggcgcctcgctctcctcttccttaggcttcgccgtgtccgccagcggggtgccgtcgaagaacatgtcgctcgggtggtgggtcatggatgagatcgcaggcatcgtcgcgcgcttgccatgcgttttcaccgggctcgacgggcggtcgggctgctgggccgcatggtgctccgccgcctgtggctgcagtgtcatcggcgcggacagcttgttcaccgtctccgcatgaatcgtcatcgcgcccattgaggggatcgtcgagcttagcggcgaaatcggcccgtcgacgtccgcataggcctcggggtcatatggggccttctttggctccgttgcagccttggagggcttgctgggtgcctttttagccgccttgcgcgctgtcgtcttcttcgcgggttccggcttcgtcggttcaggcttcgcggcctgcgcttcgtgctggaactcctgctcgtcgggaagcgtggggaacagtgcgccgagtcccctgcccaaccgtgatttcgatgccatcagttctcgttcctcctcgacgcaatggtttccagcacaatctgagagcgttcattgatctcgtaggcggcctcgcggtacgagatggcaccgagtccgcgcggatcgtacgtgatcaccgtctcaccgaagctcggcgcctcggaaatcttcacggttcgcggaatcgtcgtgtcgagcacaatgctcgggtagtgcgttttcacttcctggtacacctcgcggctgagcagcgtgcgcttgtcgaacatcgtcaccaacatcgtggagacgagcagcaacgggttgaaatgggtctgcacgaggccgatcgtgttgatgagctgcccaagaccctccagcgcatagtattcggcctggatcggaatgagcatctcgttcaccgcgcacatcgcgttgatcacgagcagccccaggctcggcgcgcagtcgacgaacacgtagtcgtagtggatctcggattcgtcgaggaacttgtcgagcgcctcgtcgagcagatcgtttcggttcggcagatccgagatctccagttccgcgccggagaggtcgatggatgccgggaccacctgcaacgtggggaattcagggcaggtctgcatgacgtcggcgatgcccgcgcgcccctcgatgacgtcgtagaccgaagggtcgcccgaattgtgcttggcgccgagcgcggtggatgcattgccttgcggatccatgtcgatcacgagcacgttcatgccggccaacgcgagcgctgccgccagattcaccgtcgtgctcgtcttgcccacgccgcccttctgattggcgacggcgatgcgccgcgtctgcgcgggctgcttgaacttcagtcgttccaatgcatgcaggcgcgtcgatgcatccgcgatttccgagccgacaccggaattctcatggtcggaaaagattcgcgcaatggtgtcttcggcgctttcgaactcagggctgctcccttggtgtgtcacgaagattcctcctcatatcgcaatgtatccagtttcttcgtgcatacggacaaacatgccgtgttttgtttcatgtgaaacgtgtcgtttccgcattcgacccagcgcgaagttatccacatctcctgtggatgattgtggataaccggtggataacccacccccataccaatctcagaaatcggctatttttcaatggttttgcagatttccacaactcaagaacacgccgatgtgcacattgtggacaactctgtggataaccagaatgccccgccactacatgtagtggttgagccgctcgaaatctctatgaaccttggtgcatccaatgggtccggtagatggtcgtcaacgatggagttggtggggtgggcgcgaggctccggcgaggtcgaggaacgtaaagggcgcttgcaatccagcgacgaagcctcgccggagcctcgcgcccaccccaccaactccgcgctatacctatacaatcactcccccatagggcggtcatgagcatttgagtcatctgcgcggccgggatcgaggtggcggctacggaacagatgaggaacgtaagggagcttgcgacagtgacgaatctgttccgtagtcgccagaccgccgcagacatggccgctactgcttgtcgacgatcagcacatgcgtgggctcaaggcccggagccacctcagcttccttgactcgcgcgtggcgcccaccgtactgcgcaatcactttgcgcgccttctcgatttcggcaccggcggagcgtcccttcagcgcaatgagctcgccatgcggcgccacgagcggcaatgtccatccggtcagcttcgtcatcggcgcgaccgcccggcaggtcaccacggtgaacggatgccgtatcgcctgcgccacctcgggagtcaccgtgttcttggcatggccgcgtcccgaggatttcccgcgtgcctgctcgagtgcggcgatcgcctcctcggagcgcgcgcgaacaatctgcacattctccagacccatcgtctccacacattcggagagccactcgcaccggcgttccatcggctcgatcagcgtgaacgtgtggtcgggcagcatggcggccgcgaccagaccggggaatccgccaccgctgccaatatcggcgaccgaacggaattgcttgccgctcgtggcctggcgaatgaacggcaccacggcggcggaattgagcagatggcgctcccacagaatgtcgacgtcacgcgggccgatcagtccgcgcggctccccctcggatttcagtttctcgtagaacgcccgcaccttcggcaatgcgtcgccgaatatggtctcgagaatcccggactgctcaatctgctcgtcgctcatcatctcactcatacccccatcctaaccaccctgccaaaccccaaggcgtgccgatcagccggttatgggaagaaaatatggaaccgcagattttcttccaatctacagacctctcgcgggaagaaaatattgaatttcagattttcttctgatgcagcccatggttcacgggaagaatatatgcgccgcgaattatttttcccatttggcagcaggtaccggcgaatcaccgcggtgcgcgatggggccggccgggaaagatgaggaacgtaagggagcttgcgacagtgacgaatccttcccggccggccccatcgcgcaccgcactgccggtagccctcgacgttgctccactacttgcacactccggccccaccgcaccgcactgccactcatgtggcctgtatgcaaaaccgacgccacaccactggagtgcgacgccggtttcatcgagacgaacaggcggctcagtcgtcgacgaggaactcgtcttcctcgactgcctcaccgtcggcctcggcacgcttcagatacaccgtgacatagcggtgcggctcctcgccatgcgagcgggaacgcaggccctcgtcacgcacgacatcgtggatgatcttgcgttcgaacgagttcattggcttgagatcgacgggctcgccggtttcgcgcacctcgtccacggcatccagggccatgtcgcgcagggtctgccgcttgcgcttgaggaagccgtcgacgtccacgatcaggtgcgaacgttcgccggtcgcctgctgcacagcaaggcgggtgagctgctgcagcgcatcgaccacctcgccgttcttgccgatcagatgcttgatgtcggtgtcgtcgtcggccacaatctggaccatcgggcggccgttgcgcacgcccatctcgatgtcgccctcgtaatccgcgatgtcgagcagcccctcgaggtaatccgcggcgatgtccgcctcctcgttgagctggtcaagcgtcttgtcgtcagtctgcaccatgttggcactccttactcatactgactcgattatatcgttggtcttgcaggtgggtgcggccgacgacaccgagtatgtcgccgaccgccttgccgatatagctcaccggtccaggcgaccggtcacttcttcctgccgcggttcttgcgcttcggctgttcgcgctggaacccttgggtcacgcgggattcggcttcctgcttggccttgatgagctcctcctcctcgagggacggccggccttccttctcacgcttcttgttctcattgtcgtggtcgcgaatctccttcgcctcggcggctgggctgcccggcgtgggaaattcgtgcacctgccacatggtgcgcagcaggttgcagatgttgttcgcgagccagtagatgagcacggcgaaaggcatggccacgccggagaagatgtacatgatcgggaagacccacagcatggccttctgcatcatctggctctggcggttcacggaggccggcgccgtgttgcggcgcatcgaatagaactgcatgtaccacaggcaggcgcacatcaacgcgacgaagatgccgatcacgaccttgccggtcgtggtggcggtggtgaacgaatcggtgatcttcacaccgaaatacgtggattgcgagaacgactccgcggtggcgacgtcgaaggcgccgagcggactgcgcttgccgcgtgcgatgtacgggatggcggagagcacgtagaacatgcacatgaacaccgggccctgcaacagcatcggcaggcaggaaccggccgggttcgcgttgttgtccttatacagcttcatcatctcgcgctgcatggcttccttcgaagccgggtcgttcttgcccttgtacttgttctggatcttcatcatcttgggctgcatcgcctgcatggcgcgcatgcccttcatgctcttgtagtagagcgggaacacgcaggcctgcaccacgatcaccaggaagatgatcgccagtgcccatgagatgccgtgctcaggcatgccaatgaacgtgaacagcttgtggaagacccacatcacccacgtcatgagccattctattggcgtgaggatcttgtagacgaatccccagatgccagcgtcaagaagaaagttttcggaattcatttaggctgcctgctccttcccgtgtgatggcagcggggtaagtctcggctcctcatgtgccttcgaccacgaacatctgtagaacagcgagaaacgttggggaacatcgtcaatatcgcaacgcttccagggcctgcagcgcaatagtctcaatgcggcgagcatgccaccgcgaatggcgccgaaccgttcgatcgcctcaagggcatagttggaacagctggggtaataatggcaagagggcggtgtattcgccgaaatccgccgttgataccaacggatgcaacgaatcatcactcgccctgcataccctgtcacgattgctccgatttgcgcatcactgcgcgaaacagcgcctgaatctgcgcttcaagagactggaaggaggcatgcgccgcccccggcttcgcacgcagcacaatatcgcagtctgcgggaagctcatgctcatagcgatgcgccaatactcggaatcgacgtttcaccgtattgcgaaccaccgcgttccccaccgatttggagacggccaaacccaaacgcctcgccggtgccgcaccggtcggggtcgacggcgtgcgcaccacgtaatgcagcacaatatccgcgtcactgacccgacggcggcgtttgagtacggcgacaaattcgcgatggtttttcagccgctccacttcgcgtgcgaatcaggcggagagggacttgcggcccttggcgcgacggcggttgatcagcgcgcggcctgcgcgggtgcgcatgcgaacgcggaagccgctcttcatgtgacggcggcggttattcggctggaatgtcctcttcatacaaactcccggttaatttaggccatgctcgtgcacggctcctcatgagtcaagctctaccaatttacaagcacccctacccgtgggcgtgattcatgcacatttccacaattgccgtggtgcataggctcgcgaaaatgtacaccgtgcgctgtgggcagattcgccgcattacccacaaacccgttgaaatatggggacaattcgcgcaacc

(The sequence listing continues in the following parts.)

The invention claimed is:

1. A heat evolved strain of *Bifidobacterium animalis* subsp. *lactis* deposited with the DSMZ under number DSM 33461 on 4 Mar. 2020 (BBi 6.6).

* * * * *